United States Patent 11,098,302 (IDENTIFICATION OF POLYNUCLEOTIDES ASSOCIATED WITH A SAMPLE) - sequence listing, part 91

SEQ ID NO: 314913 - DNA, 559 bp, Homo sapiens
  misc_feature: GZ8MTXP01ATO7R.9.78.H01.1.454.CMB.2.raw
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggttcatacatttatctagtgtgataccatatactacacagactctgtgaaggccattcacatctcaggacaacgccaaagactcactgactttgacaaatcgaaccacccngcgagccgaggacacggcccgtatattacngtgaacganaactaccgttcgcttggttacttacctgactacgttgggccacggacctgtcaccgtctctcacgccctcaccaacggcccacgtccggtcccttccccgtggccccgcccgtacgcctccgaggacgccaccgtccgagcgcaccgacgccggcccgttgggcctcggccgtggacgacggacctaacgttcccgaag

SEQ ID NO: 314914 - DNA, 682 bp, Homo sapiens
  misc_feature: GZ8MTXP01DPBKF.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgacaggctccgaggggaagggctgggagttgggttcatactatttatctagtgtgataccatatactacgcagactctgtgaaggccattcaccatctccgaagggacaacgccaaagaactcactgtactttgactaaatcgaaacctaccctggacgagcccggtaaggaccacgggtacccctaattacgttacgtgtacgaacgtaaagtaacgttaaccccgttcgacccgtttaggtttaaccttacgttgaccgtacgttacggggaccgtaacggggaacccttgggtacccaccgttcctaccctacgaccgcccctacccgaacccgaaaccgggcccctaacgttcccgggttcccctttcccccggcggtccccgtccccgtcgtccctaccgacgggacgccctacccgccggaagcgccgaacgcgggtcccggcccgttgggcctccggtcgtcggtacgaacggttacctaaccgttccgaaacg

SEQ ID NO: 314915 - DNA, 659 bp, Homo sapiens
  misc_feature: GZ8MTXP01D0115.9.78.H01.1.454.CMB.2.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgacaggctccgagggaagggctggagtggtttcatacatttatctagtgtnataccatatactacgcagactntgtgaaggccatcaccatctcaggacaacgccaagactcactgactttgacaaatcgaacacccgtgcgagcgagacacggcctatatcngnacgaanaactacccgtgaccttaggttacttaccgtgaacctacgttcgggaccgtaacgggaaccccgttcgggtacctaacccggttcctcccgtaccgaccgacccctacccaaaccccgaaaccggggtcccctaacgttcccggggtttccccttcccccggtcggacccgtccccgtcggtacccgtcccgacggaacgcccgacccgtaacccgaggaccgaccgaaccgaccggcccggcccgttcgggttccgtcgtcccgttaacggaccgtaacggttaccttaacccgttaacgtaaccgg

SEQ ID NO: 314916 - DNA, 554 bp, Homo sapiens
  misc_feature: GZ8MTXP01E37EI.9.78.H01.1.454.CMB.2.raw
  modified_base (223)..(223): a, c, t, g, unknown or other
  misc_feature (223)..(223): n is a, c, g, or t
  modified_base (469)..(469): a, c, t, g, unknown or other
  misc_feature (469)..(469): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggttcatacatttancctagtggtgataccatatactacgcagactctgtgaagggccgattcaccatctccagggacaacgccaagaactcactgactttgcaaatgaacaccctgcgagccgaggacacggcccgtatattactgtgcgagaactaaacccgtcgccctgggttattacccttgacacttggggccaggggaaccctgggtcaccgtctcctcacgcctccaccaacgggcccatcggtccttcccccnggtccgccctgcctccacggagccacctccgagacgcacgacgccggcccgttgggcctgcctggtcaaggctaacgttccaacg

SEQ ID NO: 314917 - DNA, 676 bp, Homo sapiens
  misc_feature: GZ8MTXP01A48NH.9.78.H01.1.454.CMB.2.raw
  modified_base (253)..(253): a, c, t, g, unknown or other
  misc_feature (253)..(253): n is a, c, g, or t
  modified_base (537)..(537): a, c, t, g, unknown or other
  misc_feature (537)..(537): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccattcaccatcnccgaggacaacgcaagaactcactgacttgacaaatcgaaccacccgtgccgacgcccggaggaccacggtccgttatattactggtcgacgaagaaacttaccccgttgtcccccttggtttacttacccgttgacctaaccggttcgggggccctaacggggaaacccctgggtaccctacccgtcctccctacacgccctacccaaccgaaccgggccctacgttcccgggttcccttcccccgtcggccccgtcccctcgcccgtcccgacgggggaccncccgacccgtccggaacggacgccgaccgacgggccccggtcccggtcgggccttcggccggttcggttaccgaaacgggttaccttaccgttaccgacgttacgttactccgacgtggacggcgggctcgggcgaagg

SEQ ID NO: 314918 - DNA, 555 bp, Homo sapiens
  misc_feature: GZ8MTXP01ARYKW.9.78.H01.1.454.CMB.2.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (459)..(459): a, c, t, g, unknown or other
  misc_feature (459)..(459): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggagggctggagtgggttcatacatttatctagtggtnatacatatactacgcagactctgtgaaggcatcacatcncaggacaacgcaagactcactgactttgacaaatgaaccaccctgcgagccgaggacacggccctatatacngtgacganaactacccgtncctgttatactgacacgttgggccaggaccctggtccaccgtctcctcacgcctaccaccgaacgggccctagtccggttcctcccgtccgcggccnccctacgcctccgaggacgccaacccgtcgacgacgccacgacggccggcccgttgggcctcggcccgtggtacgaacggtccttaacgtaacccg

SEQ ID NO: 314919 - DNA, 538 bp, Homo sapiens
  misc_feature: GZ8MTXP01EUCFO.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccattcaccatctccagggacaacgccaagactcactgactttgcaaatgaacaccctgcgagccgaggacacggccctatatactgtgcgagaactaacccgtcgcctggttattaccttgacacttgggccagggaaccctggtcaccgtctcctcacgcctccaccaacgggcccatccggtccttcccctggccgcccctgcctccaggcgcaccctcgagacgcacgcgcggcccgttggggctgcctggtcaggactaacgttcaag

SEQ ID NO: 314920 - DNA, 642 bp, Homo sapiens
  misc_feature: GZ8MTXP01AYJKV.9.78.H01.1.454.CMB.2.raw
  modified_base (450)..(450): a, c, t, g, unknown or other
  misc_feature (450)..(450): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaagggctggagtgggtttcatacatttatctagtgtgatacatatactacgcagactctgtgaagggccattcacatctcaggacaacgccaagactcactgactttgacaaatcgaacaccctgcgagccgaagacgacggccgtatattacgtgtcgaacgaagtaactaacccgttcgtccttaggttacttaccgtgaacctacgttcggggccaaggggtaacccctggtaccacccgttcctacccncgtaccgccctaccgaacccgaacgggcccctacgttcccggttcccttcccccggtcggcccgtcccccgtggcccctacccgagggtaccgcccgtacccgtcccggacgacgccaccgaccgggtcccggccccgttcggggcctcggtcccgtcggtaaccgaacggttaccttaaccgttccgaacg

SEQ ID NO: 314921 - DNA, 623 bp, Homo sapiens
  misc_feature: GZ8MTXP01BEM7C.9.78.H01.1.454.CMB.2.raw
  modified_base (331)..(331): a, c, t, g, unknown or other
  misc_feature (331)..(331): n is a, c, g, or t
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccgattcaccatctccgaggacaacgcaagaactcactgactttgacaaatcgaaccaccctgcgagccgaggaccacggcgtatattacngtgcgaagaactacccgttcgccctggttactaccttgactacgttggggccacgggaaccctggtcctaccgtctcctcncgccctccaccgaacgggcccacttcccggtccttccccgnggcccgccctgcctccgaggggcnccgaccctccgacgcgaccaccgacggcccggtccccgtcggggtccgtcgcccgttcgggccgaaacgggttaccttaccgtccgacggttccgttacgtccctacggtcgggacgggcccggggttactcggggccgaaacggg

SEQ ID NO: 314922 - DNA, 714 bp, Homo sapiens
  misc_feature: GZ8MTXP01BQZVL.9.78.H01.1.454.CMB.2.raw
tcagtgatacgtctcacgaccggtgctcgatttagtgtgagtagtttgggtttgggaggcttggtcaagcctggagggtccctgagactctcctgtgcagcctctggattccgcctctggattgacgttcagtgactactacatgacctgggtccgccaggctccgagggaagggctggagtggtttcatactatttatcctagtggtgataccatatactacgcagactctgtaggaagggccattcaccatctaccagggacaacgcaagactcactgactttgacaaatcgaaccaccctgcgagccgaggacacggactatattactgtgacgaagaactacccgttcgtaccccttggtttaacttaccgtgacctaaccggttcgggggcccgtaacggggaaccccgttggtccctacccgttcctcctccacgcccctacccgaaccgaacgggccctacgttccccggttccccttcccccggtcggccccgtccccgtcgcccgtcccgacgggggtaccgcccgtaccccgtaccggaacgccggacccgaaccggaccgggcccggggtccccggttcggggccctccgggtcccgttcgggttaccggaaaccgggttacccttaacccgttcccgaacggttaccgttacttaaccgtacgtcgggacgggtccggggaccgtaacgggccggaaccggg

SEQ ID NO: 314923 - DNA, 769 bp, Homo sapiens
  misc_feature: GZ8MTXP01DGZ2Z.9.78.H01.1.454.CMB.2.raw
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctccgagggagggctggagtggtttcatacatttatctagtggtnataccatatactacgcagactcngtgaaggcatcaccatctcgaggacaacgccaaagactcactgtactttgacaaatgaaccaccctgcgagccgaggacaccggtccgtatagttacgtgtacgaaccgtaaagtaacgttaaccccgtttcgtacccgtttaggtttaaacctttacccgtttaggaacccgtacggtttacgggggacccgtaaacgggggtaaccccgttcgggttaccctacccggttccgttaccctaccgaccggttacccccttaaccccgaaaccccggaaacccgggggtccccttaaccggttccccggggtttaccccctttccccccccggttcgggcccccgtcccccgttcggtaccccgttaccccggaacgggtaaccgccccgaaccccgttaacccggaaacggacggacccaaaccggccgggccccggttcccggttcgggggttccttccgggcccgttaacgggtaaccgtaacgggttaccttaacccgttaacccgtaagg

SEQ ID NO: 314924 - DNA, 584 bp, Homo sapiens
  misc_feature: GZ8MTXP01AEJUZ.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccattcaccatctccagggacaacgccaaagactcactgactttgacaaatcgaacaccctgcgagccgaggacacggccctatattactgtgacgagaactacccgtcgctggttacttactgacacgttgggcacggacctggcaccgtctcctcacgcctaccaccgaacgggccctacgtcccggtccttcccccgtcggtcccgcccgtcgcctccgacggacgccacccgtccgacgacgccacgacggccgggccccgttcggggcctcggcccgtggtccgaacgggttacctaaccgttcccgaacgg

SEQ ID NO: 314925 - DNA, 593 bp, Homo sapiens
  misc_feature: GZ8MTXP01DV2PA.9.78.H01.1.454.CMB.2.raw
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (472)..(472): a, c, t, g, unknown or other
  misc_feature (472)..(472): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaagggctggagtgggtttcatacatttatctagtggtnataccatatactacgcagactntgtgaaggcatcacatcncaggacaacgccaagaacncactgactttgacaaatcgaacnccctgcgagccgagacacggcctatattacngtagaacgaagaactaacccgttcgaccttaggttacttacttgactacgttgggaccacgggacctggtcaccgttctcctcacgccctccaccgaacggccctacgtccggtccttccccgnggcccgccccgtgcctccgacggacgccgcccgtccgaacgacggccaacgacggcccggcccggttcgggttccgtcggtccgtcgggtacgaacggttaccttaaccgtttcccgaacg

SEQ ID NO: 314926 - DNA, 579 bp, Homo sapiens
  misc_feature: GZ8MTXP01A4UYR.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgacaaatgaacaccctgcgagccgaggacacggccgtatattactgtgcgagaactaacccgttcgccccttggttattaccttgacaacttggggccagggaaccctgggtcaccgtctcctcacgcctccaacccgaacgggccccacgttcccgggtcccttccccccgtcgggcccgcccctcgacctcccgacgggggacgccaccctccgagacgcacgacgccggccctggggctcggcctggcaacggctaccttccaggcttatcactgagcgggctggcgaacgg

SEQ ID NO: 314927 - DNA, 563 bp, Homo sapiens
  misc_feature: GZ8MTXP01BWQHF.9.78.H01.1.454.CMB.2.raw
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaaggccgattcaccatctccagggacaacgccaaagactcactgactttgacaaatcgaaccaccctgcgagccgaggacacggcgtatattactgtgcgaagaactaacccgttgcccctggttactactgactaacgttgggcagggaccctgtcaccgtcnctcncnccnccacacggcccagtccgtcctccccngccgccncgcctccgagggcgccacctccgagacgcacgacgccggtcccgtcgggcctgccgtggttacaaacggttctaaccgtcacgttcgttatcacgtggacggcgggttcgtggcgaacggg

SEQ ID NO: 314928 - DNA, 692 bp, Homo sapiens
  misc_feature: GZ8MTXP01B1R79.9.78.H01.1.454.CMB.2.raw
  modified_base (182)..(182): a, c, t, g, unknown or other
  misc_feature (182)..(182): n is a, c, g, or t
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctcgagggagggctggagtggttcatactatttatctagtgtnatacatatactacgcagactgtgtaggaacggcattcaccatctacgaggacaacncaaagactcactgtactttgactaaatcgaaaccacccgtggaccggacgaccggaacggaaccgaccgggtaccccgttaattattacgtggtacgaaacggaaacgtaacccgtttaaccccggttcggtacccgtttagggttttaacctttaacccgttacggaacctacgggttacggggacccgtaacggggtaacccgtcggtacccgtacccgttcctacccgtacgaccgccctacccgaaccgtaaccgggcccctacgttccccggttccccttcccccgtcggcccgcccgtcgcctaccgacggacgcccacccgtccgacgacgccaccgacggtcccggcccgttcgggccgtcgccgtcggtacgaacggttacccttaacgttccgaacg

SEQ ID NO: 314929 - DNA, 728 bp, Homo sapiens
  misc_feature: GZ8MTXP01EZU8Q.9.78.H01.1.454.CMB.2.raw
  modified_base (355)..(355): a, c, t, g, unknown or other
  misc_feature (355)..(355): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtggtttcatacatttatcctagtggtgataccatatactacgcagactctgtgaagggcattcacatctccaggacacgccaagactcactgactttgacaaatcgaaacaccctgacgagccgaggacacggccccgtatattacngtcgaacgaagaacttaaaccccgttcgacccttagggttttaacttaaccctttggaaccctaccgtttacgggggcccgtaacggggtaaaccccgttacgggtccctaaccccggttccgttcccctaccgaaccgtccccttaccccgaaacccgaaaccggggtaccccctaacgtttcccggttccccgtttcccccccggttcgggccccgtacccccgttcggtcccgtcccgtacgggaaccgcccgaccccgtaacccggaagaaccggccaaccgaaccggcccgggcccccgttgggggccctcgggtccccgtaacggggttaccgaaacgggttacccttaacccgtttcccgaaacgg

SEQ ID NO: 314930 - DNA, 586 bp, Homo sapiens
  misc_feature: GZ8MTXP01D1WSJ.9.78.H01.1.454.CMB.2.raw
  modified_base (182)..(182): a, c, t, g, unknown or other
  misc_feature (182)..(182): n is a, c, g, or t
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctccgagggaggggctggagttgggtttcatacatttatctagtggtnataccatatactacgcagactctgtgaagggccaattcaccatctccaagggacaaacgccaaagactcactgtactttgacaaaatcgaaccnccctgcgagccgaggacacggccctatattactgtcgaacgataacgttacccgtgacccttaggttacttaccgtgactacgttcgggaccacgggaaccctggtccaccgtctcctcacgcctccaaccgacgggccctacgttccggtcccttccccgtgcccgtccctcgcctccgacggacgccaccgtcgacgacgcgacgacggcgcccgttcgggctcgcccgtggtcgaacggacttaacgttccgaag

SEQ ID NO: 314931 - DNA, 594 bp, Homo sapiens
  misc_feature: GZ8MTXP01DWPU6.9.78.H01.1.454.CMB.2.raw
tcagtgatacgtctcacgaccggtgctcgatttagtgtgagtagtttgggtttgggaggcttggtcaagcctggagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccattcaccatctccaggacaacgccaaagaactcactgactttgacaaatgaaccacctgcgagccgaggacacggccgtatattactgtgacgagaactaacccgttcgccccttaggttacttaccgttgacctaacgttggggcccagggtaacccctgggtccacccgtctcctcacgccctaccaccgaacgggcccacgtccggtccttcccccgtggcccgccctcgcctccgaggggcgccacctccgagcgccacgacgccggcccgtgggcctgcccgtggccaaaggacctaacttcccgagttccgttactccgagtcggacggccgggctcggcgaacggg

SEQ ID NO: 314932 - DNA, 664 bp, Homo sapiens
  misc_feature: GZ8MTXP01CVXFU.9.78.H01.1.454.CMB.2.raw
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaaggccattcacatctcaggacaacgccaagacncactgactttgacaaatgaacaccctgcgagccgaggatacggcccgtatattacgngtgacgaagtaactaaaccccggttcgacccgttgggttacttacccgtttgaacctacgtttcgggggacccgaacggggtaaacccctgggtacccgaccgttcctccctccaacgcccctaccaacccgaaacggggccccaacgttcccggggttcccttccccccgtgggccccgtccccgttcggcccttcccgaacgggacgacccacccgtcccggaacgacggccaaccgacggcccgggccccgttggggcccttcggccccgtggttaccgaacgggttaccttaaccgtttcccgaacgg

SEQ ID NO: 314933 - DNA, 429 bp, Homo sapiens
  misc_feature: GZ8MTXP01C4OE7.9.78.H01.1.454.CMB.2.raw
  modified_base (419)..(419): a, c, t, g, unknown or other
  misc_feature (419)..(419): n is a, c, g, or t
  modified_base (422)..(429): a, c, t, g, unknown or other
  misc_feature (422)..(429): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaaggccattcacatctcagggacaacgccaagaactcactgactttgacaaacatccggtcttccccctggccacccctcctccaagacgcacctcgtcggggcacacgccggcctgggccctggctggtcaaggaactacttccactagtgcgactggacgcgggctggacaacgggcgacanagnnnnnnnn

SEQ ID NO: 314934 - DNA, 588 bp, Homo sapiens
  misc_feature: GZ8MTXP01COI65.9.78.H01.1.454.CMB.2.raw
  modified_base (198)..(198): a, c, t, g, unknown or other
  misc_feature (198)..(198): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctggagtgggtttcatacatttancctagtggtgataccatatactacgcagactctgtgaagggccattcaccatctccaggacaacgccaagaactcactgactttgacaaatcgaacacccctgacgagccgaggaccacggccgtatattactggtgcgaagaactaaccccgttcgcccccttgggtttaacttacccgttgaccgtaaacgtttgggggcccaggggtaacccctgggtccaccgtctcctcacgcctccaccgaggcccagtcggtcctccccgtgcgccctgctccaggggacncaccncgagcgcacgacgccggccgtcggcctcgccgtggacgaacggttacctacgtccacgttacgttactcgacgtgcgggcgggttcgtgggcgaagg

SEQ ID NO: 314935 - DNA, 707 bp, Homo sapiens
  misc_feature: GZ8MTXP01AQD3Q.9.78.H01.1.454.CMB.2.raw
  modified_base (304)..(304): a, c, t, g, unknown or other
  misc_feature (304)..(304): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctggtaggaacgggcctattccaccatctccagggacaaccgccaaagactcactgacttgacaaatcgaaccnccctgccgacgccgaggacacggcgtatacttactgtagacgaagaaacttaacccgttcgaccccttaggttacttaccttgacctaacggttcgggggccacggggtacccctgggtacccaccgttctcctacaccgccctacccgaaccgaaccgggtcccacgttcccggttccccttcccccgtcggccccgtccccgttcgccccgtacccgaacgggggaccgaccccgtaacccgccggaacggaccgccaaaccggaccgggcccgggtcccccggtggggtcccgtcgggtcccggttgggttacccgtaaacgggttacccttaacccgttaccgaacgggttaccttacgtccgacgtcggacgggtccgggacgtcggaaccgaacggg

SEQ ID NO: 314936 - DNA, 571 bp, Homo sapiens
  misc_feature: GZ8MTXP01ETP4N.9.78.H01.1.454.CMB.2.raw
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgtttcagtgactactacatgacctgggtccgccaggctccgagggagggctggagtgggtttcatacatttatctagtgtgataccatatactacgcagactctgtgaagggccattcaccatctccaggacaacgcaagaacncactgactttgacaaatgaacaccctgcgagccgagacacggccctatattacgngtgacgaagaactacccgtcnccttgttacttactgacacgcgggcaggaccctgcaccgtctcctcacgcctacaaccgaacgggcccacgttccggtcccttcccccgtggccccgcccgttcgccgtccgacggacgccacctccggagacgccgacgacgccggcccgttggccgtcgcccgtggaccgtaacggttacctaaccgttccgaacgg

SEQ ID NO: 314937 - DNA, 559 bp, Homo sapiens
  misc_feature: GZ8MTXP01EHRW1.9.78.H01.1.454.CMB.2.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggagggctggagtgggtttcatacatttatcctagtgtgataccatatactacgcagacttcgtgtggaagggcctattcaccatcctccgaagggacaacgccaaagactcactgactttgacaaatcgaacaccctgacgagccgaggaccacggccctatactacngtgaacgaanaactacccgttcgcttaggttacttaccgtgactacgttcgggacaacggacctggtacaccgtctctcacgcctccacacggcctacgtccgtcctcccctggccncccgtncctcgagacnccnccgtccgagcgcacgcgccgccgttggctcgccgtggtcacggacctaacgttcgaacg

SEQ ID NO: 314938 - DNA, 594 bp, Homo sapiens
  misc_feature: GZ8MTXP01DC8FT.9.78.H01.1.454.CMB.2.raw
  modified_base (182)..(182): a, c, t, g, unknown or other
  misc_feature (182)..(182): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctccgagggaaggggctggagtggttcatacatttatctagtggtnataccatatactacgnagactntgtgaaggccattcacatcncaaggacaacgccaaanacncactgactttgacaaatgaacaccctgcganccgagcacggtcctatattacngtgaacgaagaacttacccgtcgaccttaggttacttacgttgactacgttcggggacctaacgggaaccctggtacctaccgtcctcctcacgccctaccaaccgacggccctacgtccggtcccttcccccgtgcccgcccgtcgccgtccgacggacgccaccgtcgacgacgaccacgacggcccggaccgttcgggcctcggccgttcggtaacgaacggttaccttaaccgttccgaacgg

SEQ ID NO: 314939 - DNA, 646 bp, Homo sapiens
  misc_feature: GZ8MTXP01EVI61.9.78.H01.1.454.CMB.2.raw
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
  modified_base (636)..(636): a, c, t, g, unknown or other
  misc_feature (636)..(636): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctgggagtgggtttcatacatttatcctagtggtgataccatatactacgcagactctgtggaagggccattccaccatctccagggacaacgccaagactcactgtacttgacaaatcgaaccaccctgacgagccgaggacacggctatattacgtgtgacgaagtaacgtaacccgttcgccccttaggtttacttacccgttgaaccctaacggttcgggggcccaacggggaaaccccttgggtccctaacccggtctccctcacgccctacccaccgaaccgggcccacgttcccggtcccctttcccccgtcggccccgtacccgtctacccgtccgaacggggacgcccgaacccgttcggacgacgccaaccgcggccggccccgtgggcctcggcccgtcggttacgacggttaccgtacttccgagttacgttacnctagcgnggcggcngggcgaacgg

SEQ ID NO: 314940 - DNA, 656 bp, Homo sapiens
  misc_feature: GZ8MTXP01BIGBB.9.78.H01.1.454.CMB.2.raw
  modified_base (182)..(182): a, c, t, g, unknown or other
  misc_feature (182)..(182): n is a, c, g, or t
  modified_base (252)..(252): a, c, t, g, unknown or other
  misc_feature (252)..(252): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (568)..(568): a, c, t, g, unknown or other
  misc_feature (568)..(568): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctccgagggagggctggagtggtttcatacatttatctagtgtgatacatatactacgcagactcngtgaaggccgatcacatctcaggacaacgcaagactcactgactttgacaaatgaaccnccctgacgagcccgaggacacggaccctatattacgngtagacgaagtaactaaacccgttcgccctttaggttactttaaccgtgaaccgtacgttcggggaccaacggggtaaccctgggtaccctaaccccgtccttccgaccaccgacccccgtacccaaacccgaaaccggggcccctaacggttccccggttccccttcccccgtcggccccgtccccgtcgccccgtccgaacggccgaccctaaccccncggaacgcggccaacggaccgccccgggcccgttcgggccgtcggtcccgtcgggtaaccaacgggttaacctccgttaaccgaacgg

SEQ ID NO: 314941 - DNA, 584 bp, Homo sapiens
  misc_feature: GZ8MTXP01DL6ZO.9.78.H01.1.454.CMB.2.raw
  modified_base (182)..(182): a, c, t, g, unknown or other
  misc_feature (182)..(182): n is a, c, g, or t
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggctccgagggaaggggctggagtggtttcatacatttatctagtgtnatacatatactacgcagactctgtgaaggccattcacatctcgaaggacaacgccaagactcactgtactttgacaaatcgaacnccctgcgagccgagacacgcctatatacngtgaacgataactaccgttcgcttgtacttctgactacgttgggccgacggaccgtgtaccaccgtcctcctcacgccctaccaaccgaccgggccctacgttccggttccctttcccccgtcgcccgccctcgccctccgacggacacccgtcccaaccgacgacgccgaaccgcggcccggccgttcgggcgtcgtccgtcggacgaacggttaccttaaccttaaccgtaacgg

SEQ ID NO: 314942 - DNA, 451 bp, Homo sapiens
  misc_feature: GZ8MTXP01BS3U7.9.78.H01.1.454.CMB.2.raw
  modified_base (322)..(322): a, c, t, g, unknown or other
  misc_feature (322)..(322): n is a, c, g, or t
  modified_base (441)..(451): a, c, t, g, unknown or other
  misc_feature (441)..(451): n is a, c, g, or t
tcagtgatacgtctcacgaccggtgctcgatttagtgtgagtagtttgggtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacgttggggccagggaaccctggtcaccgtctccctcagccctccaccgaacgggccccagtccggtccttccccccgtggccncccctgcctccaggacgccaccctccgagacgcacgacgccggccctgggctgccctggtcccaaggactacttccagtaacgtatcactgacggcgggctgggacaaggcgcagtagnnnnnnnnnnn

SEQ ID NO: 314943 - DNA, 749 bp, Homo sapiens
  misc_feature: GZ8MTXP01ALOZI.9.78.H01.1.454.CMB.2.raw
  modified_base (223)..(223): a, c, t, g, unknown or other
  misc_feature (223)..(223): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctggtccgccaggctccgagggagggctggagtgggtttcatacatttanctagtggtgataccatatactacgcagactctgtggaacgggccgtattccaccatcctaccgagggaccaaacgccaaagaacctcactcgactttagacaaaatcgaaaccaccccgtgaccggagccggaaggaccaccggtccccgttaatactttactggtacgacgaagtaaccgttaaccccggttcgaccgtttaggtttaactttacccgttaggaaccctacgggtttacgggggaccctaacgggggtaaaccccgttcgggttacccgaaccccggttcccttaccctaccgaccggtacccctacccgaaacccgtaaaccggggcccctaacgtccccggggttccctttaccccccggcggtccccggccccttacggcccctacccggtacggaccgacccgtacccgtaacccggacggaccgaccgaccggacggccccggcccggttggggccctcgggtcccgtaacgggttacgaacgggttacccttaaccgtttccgaaacgg

SEQ ID NO: 314944 - DNA, 783 bp, Homo sapiens
  misc_feature: GZ8MTXP01DOZO8.9.78.H01.1.454.CMB.2.raw
  modified_base (252)..(252): a, c, t, g, unknown or other
  misc_feature (252)..(252): n is a, c, g, or t
  modified_base (299)..(299): a, c, t, g, unknown or other
  misc_feature (299)..(299): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatactatttatcctagtggtgataccatatactacgcagactctgtaggaaggccattcaccntctaccgagggacaacgcaaagaactcatgacttgacaaatgaaccncctgacgagccgagaccgacggactattattacgtgtggacgaagtaaaccttaacccggttccgtaccgttacgggttttaactttacccgttaggtacccgtaaaccgggtttcgggggaaccccgtaaacgggggtaaacccccttcggggttaccctacccccggttcttaacccctcgaaccgtccctaaccccgaacccggaaaccgggtcccctacgttcccgggttcccctttccccgtcgggtccctaccccgtcgtcccgttacccgaagggggtacccgaccccgtaacccgtacccggaacggaccgaccgtaaccgaaccgggtccccgggtccccgtgggtacccgtccggtaacccggttcggttaccgaaaacgggttcccttaaacccgtttccgaaacgggttcttaaaaccttcgtaaaccgggtcgggaacgggccgggttacggtaaccgggaacgtaacggg

SEQ ID NO: 314945 - DNA, 675 bp, Homo sapiens
  misc_feature: GZ8MTXP01AS45D.9.78.H01.1.454.CMB.2.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (571)..(571): a, c, t, g, unknown or other
  misc_feature (571)..(571): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggcctccgagggaagggctggagtggtttcatacatttancctagtggtgataccatatactacgcagactctgtgaagggccattcaccatctccgaggacaacgccaagactcactgtactttgacaaatcgaaccncccgtgcgagccgagacacggtcccgtatattacgngtgaaccgagtaactacccgttcgcttaggtttaacttacccgttaaagacggtttcggggacccgaacggggtaaccccgtggtacccgtaacccgttcctacccctacgaccgtaccccttcccgaacccgaacgggcccctaacgggttcccggttccccgttcccccgtacgggcccgtccccgttcggaccctccgacgggtaccnccgtaacccgttcccggaagacgacgtaaaccgcggcccgtcccggttggggccttacggccgtcggtaaccaacgggtaccttaccgtccgttaacgtaaccg

SEQ ID NO: 314946 - DNA, 621 bp, Homo sapiens
  misc_feature: GZ8MTXP01CZBHC.9.78.H01.1.454.CMB.2.raw
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (530)..(530): a, c, t, g, unknown or other
  misc_feature (530)..(530): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggctccgagggaggggctggagtggttcatactattatctagtgtnataccatatactacgcagactgtgtggaaggccattcacatcncgaggacacgcaagactcactnacttnacaaatacgaacaccctgacgagaccgaggacaccggcctatacttacgtgagacgaagaacctaccgtcgacttgttacttactgactcgttacggccgaacgggacctggtacctaccgttccgtcctacacgcccctaccgaacccgaaccgggcctaccgttcccggttccccttcccccggtcgggtcccctccccgtcgtacccgtaccgacggaccgtaccncccgtaacgacgacaccgacgccggcccggcccgttcgggttcgtccggtccctcgggtaaccaacgggttaccttaaccgttccgaacgg

SEQ ID NO: 314947 - DNA, 599 bp, Homo sapiens
  misc_feature: GZ8MTXP01EBGFD.9.78.H01.1.454.CMB.2.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaaggccattcaccatcnccagggacaacgcaagaactcactgactttgacaaatgaaccacccngcgagccgaggacacggctatattactgtgacgaagaactaacccgttcgccccttggttacttacctgactacgttcgggccgacgggaaccctggtccaccgtcncctcacgcctaccacgacggcccagttccggtccttccccgcggccgccctgcctccgacggggacgccacccgtccgagacgcgacgacgccgtcccgtggacctcgccgtggaccgaaacggttaccttaccgttaccgacgacgttactccgtaacgtggacgggccgggcgtcgggaacgtaacgggg

SEQ ID NO: 314948 - DNA, 540 bp, Homo sapiens
  misc_feature: GZ8MTXP02I6HJM.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaagaactcactgactttgcaaatgaacaccctgcgagccgagacacggccccgtatattactgtgcgagataacccgttgcctggttattaccttgacacttggggccaggggaaccctggtcaccgtctcctcagcctccaccaagggcccatccggtccttccccctggccgccctgcctccaggacgcacctccgagacgcacacgccgccctggggctgcctggtccaaggactacttccaag

SEQ ID NO: 314949 - DNA, 534 bp, Homo sapiens
  misc_feature: GZ8MTXP02FXXB9.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggcccgtatatactgtgcgagataacccgttcgcctggttattaccttgacacttggggccagggaaccctggtcaccgtctcctcagcctcaccaacgggcccatcgtccttcccctggccgccctgcctccaggacgcacctccgagacgcacacgcgccctgggcctgcctggtcaaggactacttccag

SEQ ID NO: 314950 - DNA, 582 bp, Homo sapiens
  misc_feature: GZ8MTXP02JBHU6.9.78.H01.1.454.CMB.2.raw
  modified_base (356)..(356): a, c, t, g, unknown or other
  misc_feature (356)..(356): n is a, c, g, or t
  modified_base (502)..(502): a, c, t, g, unknown or other
  misc_feature (502)..(502): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccattcacatctccaggacaacgccaagaactcactgactttgacaaaatgaaacaccctgcgagccgaggacacggccccgtatattacngtgcgagactaacccgttgccttgttacttacctgacacttggggccagggaaccctggtcaccgtctcctcacgcctccaccgaaacgggcccaacgttccgggtccctttcccccgtcggcccgcccctgccgtccagggaccnccacccgtccgacgacgaccacgacggccggcccgtcggcctcgccgtacggtacgaacggtaccttaccgtaccgaacg

SEQ ID NO: 314951 - DNA, 566 bp, Homo sapiens
  misc_feature: GZ8MTXP02GRL2V.9.78.H01.1.454.CMB.2.raw
  modified_base (355)..(355): a, c, t, g, unknown or other
  misc_feature (355)..(355): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggcccgtatattacngtgcgagactaacccgttcgcctgttattacctgacacttggggccagggaaccctggtcaccgtctcctcacgcctccaccgaacgggcccatccggtccttcccccgtggccgccctcgcctccaggacgccaccctccgagacgccacgacgccggcccgtggggcctcggccctcgggtaccaacgggaccttaccgttaccaacgg

SEQ ID NO: 314952 - DNA, 533 bp, Homo sapiens
  misc_feature: GZ8MTXP02JSWPN.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccccgtatattactgtgcgagataacccgttgcctggttattaccttgacacttggggccagggaaccctggtccaccgtctcctcagccctccaccagggcccatcggtccttcccctggccgccctgctccaggacgcacctccgagagcacacgccgccctgggctgcctggtcaaggactactcacg

SEQ ID NO: 314953 - DNA, 569 bp, Homo sapiens
  misc_feature: GZ8MTXP02HMZS5.9.78.H01.1.454.CMB.2.raw
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtgtgataccatatactacgcagactctgtgaagggccattcaccatcnccaggacaacgccaagactcactgactttgacaaatgaacaccctgcgagccgagacacggcccgtatattacngtgcgagactaacccgttgccttggttatacctnacacgttgggccagggaaccctggtcaccgtctcctcacgcctccaccgaaacgggcccaacgttccggtcccttcccccgtcggccgccccgtgccctccgaggacgccacccgtccgagacgcacgacgccggccctggggcctcggcctacgggtaccaaacggacctactttaccgaacg

SEQ ID NO: 314954 - DNA, 553 bp, Homo sapiens
  misc_feature: GZ8MTXP02IW1NQ.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagactcactgactttgcaaatgaacaccctgcgagccgaggacacggcccgtatattactgtgcgagataacccgttcgcctggttataccttgacacgttggggccagggaaccctggtcaccgtctcctcagcctccaccaacgggcccatccggtccttccccctggccgccctgcctccaggacgcaaccctccgagacgcacgacgccggcccgtgggcctcgcccgtggtacaacggtactaccttacaacgg

SEQ ID NO: 314955 - DNA, 583 bp, Homo sapiens
  misc_feature: GZ8MTXP02HOVFJ.9.78.H01.1.454.CMB.2.raw
  modified_base (356)..(356): a, c, t, g, unknown or other
  misc_feature (356)..(356): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacattttattctagtggtgataccatatactacgcagactctgtgaagggccattcaccatctccaggacaacgcaaagactcactgactttgacaaaatgaaacaccctgcgagccgaggacacggccctatattacngtgcgagactaacccgttgccttaggtttattacccttgacctacgttggggaccgagggaaccctggtccaccgtctcctcacgcctacaaaccgaacgggcccacgttccggtccttcccccgtcggcccgccctcgcctccgacggacgccacccgtccgacgacgacacgacggcccggccgtcgggctcgccgtcggtacgaacggtactaccgttacaacg

SEQ ID NO: 314956 - DNA, 535 bp, Homo sapiens
  misc_feature: GZ8MTXP02HQ1A8.9.78.H01.1.454.CMB.2.raw
  modified_base (363)..(363): a, c, t, g, unknown or other
  misc_feature (363)..(363): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggcccgtatattactgtgcganactaacccgttcgcctggttataccttgacacgttgggccagggaaccctggtcaccgtctctcagcctcaccaaggcccatcgtcctcccctgccgcctcgctccagacgcacctccgagacgcacacgccggccctggggctcgcctaggtcaaggacctacttccaacg

SEQ ID NO: 314957 - DNA, 544 bp, Homo sapiens
  misc_feature: GZ8MTXP02FN9GO.9.78.H01.1.454.CMB.2.raw
tcagtgatacgtctcacgaccggtgctcgatttagtgtgagtagtttgggttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagactcactgactttgcaaatgaacaccctgcgagccgaggacacggcccgtatatactgtgcgagactaacccgttgcctgttattaccttgacacgttgggccagggaaccctggtcaccgtctcctcacgcctccaccaacgggcccagtccggtccttcccccgtggcccgccctgcctccgacggacgcacctccgagacgcacacgccgcccgtggctcgccgtggtacaaggactactccaacg

SEQ ID NO: 314958 - DNA, 575 bp, Homo sapiens
  misc_feature: GZ8MTXP02G8YNO.9.78.H01.1.454.CMB.2.raw
  modified_base (234)..(234): a, c, t, g, unknown or other
  misc_feature (234)..(234): n is a, c, g, or t
  modified_base (352)..(352): a, c, t, g, unknown or other
  misc_feature (352)..(352): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtgtnataccatatactacgcagactctgtgaagggccattcaccatctccaggacaacgcaagactcactgactttgacaaatgaacaccctgcgagccgaggacacggcccgtatattacngtgacgaagactaacccgttgccgttagttacttaccttgactacgttcggggcccagggaaccctggtcaccgtctcctcacgccctccaaccacgggcccacgtccgtcccttccccgtggcccgccctcgcctccgaggacgccacccgtccgacgacgccaacgacgccggcccgtcgggctcggccgtacggtaccaacggacctaccgtaccgaacg

SEQ ID NO: 314959 - DNA, 548 bp, Homo sapiens
  misc_feature: GZ8MTXP02IJ7PX.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccaggggaaggggctggagtgggtttcatacatttatcctagtggtgataccatatactacgcagactctgtgaaggccattcacatctccaggacaacgccaaagactcactgactttgacaaatgaaccaccctgcgagccgaggacacggcccctaatattactgtgcgaagacttaacccgttcgcctaggtttacttaccttgacacgttgggccagggacctgtcacgtctctcacgcctcaccgaaggcccagtccggtccttccccgtcgccgccctgacctccgagacgcaccgtccgagacgcacgacgtccgcccgtggctaagcccgtggcaacggctacgtcaacg

SEQ ID NO: 314960 - DNA, 589 bp, Homo sapiens
  misc_feature: GZ8MTXP02JSCDU.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtgtgataccatatactacgcagactctgtgaagggccgattcaccatctccgaggacaacgccaaagactcactgactttgacaaatcgaacaccctgcgagccgaggacacggcccgtatattactgtgacgaatactaacccgttcgccttaggttaactttacctgaacctacgttcggggaccgacgggtaacccgtcggtccaccgtctcctcacgcctccaccgaacggcccacgtccggtcccttcccccgtcggccgcccgtcgtcctccgaggacgccacccgtccgagacgcacgacggccggcccgtgggcctcgccgtcggtacgaacggaccttaccgtacgaacg

SEQ ID NO: 314961 - DNA, 554 bp, Homo sapiens
  misc_feature: GZ8MTXP02JRXYU.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaaagaactcactgactttgacaaatgaacaccctgcgagccgaggacacggccccgtatattactgtgcgagactaacccgttgcctgttattaccttgacacgttgggccagggaaccctggtcaccgtctcctcacgcctccaccgaacgggcccactccggtcccttcccccgtcggccgcccgtcgcctccgaggacgccacctccgagacgcacacgccgccctgggctgcctcggtacaaggactacttccaacg

SEQ ID NO: 314962 - DNA, 544 bp, Homo sapiens
  misc_feature: GZ8MTXP02FMDX1.9.78.H01.1.454.CMB.2.raw
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtgtgataccatatactacgcagactctgtgaagggccattcaccatctccagggacaacgccaagactcactgactttgcaaaatgaacaccctgcgagccgaggacacggcccgtatatacngtgcgagataacccgttncctgttattactgacacttggggccagggaaccctggtcaccgtctcctcacgccctccaccaaacgggcccaagtccggtccttccccctggcccgccctgcctccaggacgcacccgtccgagagcacgacgccggccctgggctgcctcggtacaaggactacttccaag

SEQ ID NO: 314963 - DNA, 407 bp, Homo sapiens
  misc_feature: GZ8MTXP02HOXBP.9.78.H01.1.454.CMB.2.raw
  modified_base (406)..(407): a, c, t, g, unknown or other
  misc_feature (406)..(407): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctcagggacaacgccaagaactcactgactttgcaaacatcggtcttccccctggccaccctcctccaagagcacctctggggcacagcggccctgggcctgcctgtcaaggctacttccactagtgcgactgagcgggctggcaagcgcatagnn

SEQ ID NO: 314964 - DNA, 592 bp, Homo sapiens
  misc_feature: GZ8MTXP02I69CZ.9.78.H01.1.454.CMB.2.raw
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctgggagtgggtttcatacatttatcctagtggtgataccatatactacgcagactctgtgaaggccatcaccatcnccaggacaacgccaaagaactcactgactttgacaaatgaacaccctgcgagccgagacacggcccgtatattacngtgcgaagactacccgtcgccttgttactaccttgactacgttcgggaccagggaaccctggtcaccgtctcctcacgcctaccaccgaacggccctacgttccggtcccttcccccgtcggcccgtcccgtcgcctaccgaggacgccaacccgtccgacgacgaccacgaccggccggccccgtggggccctcggtcccgtcgggtaccgaacggtaccttacccgttaccgaacg

SEQ ID NO: 314965 - DNA, 563 bp, Homo sapiens
  misc_feature: GZ8MTXP02HSP5B.9.78.H01.1.454.CMB.2.raw
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (467)..(467): a, c, t, g, unknown or other
  misc_feature (467)..(467): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagaactcactgactttgcaaatgaacaccctgcgagccgaggacacggcccgtatattactgtgcganactaacccgttcnccttgttacttacttgactacgttggggccagggaaccctggtcaccgtctcctcacgcctccacaacgggcccagtccggtccttccccgnggccgccctgctcccgaggacgcacccgtcgagacgcacgacgccggtccctggggctcggccgtacggtccaacgggtacctaccgttccaacgg

SEQ ID NO: 314966 - DNA, 535 bp, Homo sapiens
  misc_feature: GZ8MTXP02JSTWU.9.78.H01.1.454.CMB.2.raw
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcccctggttattaccttgacacttggggccagggaaccctggtcaccgtctcctcacgcctccaccaagggcccatcggtcttccccctggccgccctgcctccaggngcacctccgagagcacncgcgccctgggctgcctggtcaacggactactccagacgtatcactgacgcggctggcagg

SEQ ID NO: 314967 - DNA, 600 bp, Homo sapiens
  misc_feature: GZ8MTXP02JUMKT.9.78.H01.1.454.CMB.2.raw
  modified_base (278)..(278): a, c, t, g, unknown or other
  misc_feature (278)..(278): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacacagactctgtgaaggccattcacatcncaggacaacgccaagactcactgactttgacaaatcgaacaccctgcgacgccgaggacacggccctatattactgtgacgagactaacccgttcgccttggttaacttacccttgacctacgttcggggacccgacgggaaccctggtcccaccggtcctccctcacgccctccacccgaacggcccacgttccggtccttcccccgtggcccgcccgtcgccgtccgacggacgtcccacccgtccggacgacgccacgacggtcccggcccgtcgggcctcggtccgtcggtacgaacggtacctaccgtacgaaccgg

SEQ ID NO: 314968 - DNA, 553 bp, Homo sapiens
  misc_feature: GZ8MTXP02G24IK.9.78.H01.1.454.CMB.2.raw
  modified_base (422)..(422): a, c, t, g, unknown or other
  misc_feature (422)..(422): n is a, c, g, or t
  modified_base (480)..(480): a, c, t, g, unknown or other
  misc_feature (480)..(480): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagactcactgactttgcaaaatgaacaccctgcgagccgaggacacggccccgtatatactgtgcgagataacccgtgcctgttattaccttgacacgttggggccagggaaccctggtcacccgtcncctcacgcctccaccgacggcccatccggtctcccctggccgccctcgctcacggacncaccgtccgagacgcacacggccgcccgtggggcctgcccgtacggtccgaaaggtcctaacgtttccaacgg

SEQ ID NO: 314969 - DNA, 539 bp, Homo sapiens
  misc_feature: GZ8MTXP02J3EI6.9.78.H01.1.454.CMB.2.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (504)..(504): a, c, t, g, unknown or other
  misc_feature (504)..(504): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtnataccatatactacgcagactctgtgaagggccattcaccatctccaggacaacgcaagacncactgactttgacaaatgaacaccctgcgagccgaggcacggcccgtatattacngtgcgagataacccgttcgccttgttataccttgacacgttggggccagggaaccctggtcaccgtctcctcacgcctccaccgaacgggcccatccggtccttcccccgtggccgccctgcctcccgagacgaccacctccgagacgcacncgcgccctggctgcctaggcaaggctacttcaacg

SEQ ID NO: 314970 - DNA, 574 bp, Homo sapiens
  misc_feature: GZ8MTXP02GXBOV.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaaagaactcactgactttgacaaatgaacaccctgcgagccgaggacacggcccgtatattactgtgcgagactaaccccgttcgccttggttacttaccttgactacgttggggccagggaaccctggtccaccgtctcctcacgcctccaccacgggcccacgtccggtccttcccccgtggcccgccctcgcctcccgaggacgccacctccgagacgccacgacgccggcccgtggggcctgcccgtcggtacaacggtacctaccgttaccaacgg

SEQ ID NO: 314971 - DNA, 587 bp, Homo sapiens
  misc_feature: GZ8MTXP02GQC5W.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgcaagaactcactgactttgacaaatgaaccaccctgcgagccgaggacacggccgtatatactgtgcgaagaactacccgttcgccccgttggttacttaccgtgaccacgttcggggccaggggaccctggtccaccgtctcctcacgcctacccaccgacgggcccagtccgtcccttccccgtggcccgccctcgcctccgaggacgccacccgtccggacgacgccacgcgccggcccgtgggctcgccgtcggacaacggaccttacgtccgacgtaccgtactaacgacgtggacgcgggactcgggacgaacgg

SEQ ID NO: 314972 - DNA, 531 bp, Homo sapiens
  misc_feature: GZ8MTXP02ILQBG.9.78.H01.1.454.CMB.2.raw
  modified_base (437)..(437): a, c, t, g, unknown or other
  misc_feature (437)..(437): n is a, c, g, or t
tcagtgatacgtctcacgaccggtgctcgatttagtgtgagtagtttgggtttgggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacacccctgcgagccgaggacacggccgtatattactgtgcgagataaccgttcgccctggttataccttgacacttggggccagggaaccctgggtcaccgtctcctcagcctcaccaagggcccatcgtccttcccctggccnccctgctccaggacgcacctccgagacgcacagccggcctgggctcgcctggtcacggactacttccagcgtatcactgacgcggctggcaagg

SEQ ID NO: 314973 - DNA, 592 bp, Homo sapiens
  misc_feature: GZ8MTXP02HAUJ8.9.78.H01.1.454.CMB.2.raw
  modified_base (259)..(259): a, c, t, g, unknown or other
  misc_feature (259)..(259): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
  modified_base (472)..(472): a, c, t, g, unknown or other
  misc_feature (472)..(472): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgngaaggcattcacatctcaggacaacgcaagactcactgactttgacaaatcgaacaccctgacgacgaccgagacgacggccccgtatattacngtgcgaagacttaacccgttcgccttaggttacttacccgtnactacgttgggccgaggacctggctaccgtcctctacncgcctccacgacggcccagtccggtacccttcccccggngcccgtcccgtcgtcctccgaacggccgaccacccgtccggaacgtcgaccaacgcggcccggtacccgtcggggcctcggtccgtcgggtaccaacggtaccttaccgttaccgaacgg

SEQ ID NO: 314974 - DNA, 556 bp, Homo sapiens
  misc_feature: GZ8MTXP02FVA6W.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccaggacaacgccaagaactcactgactttgcaaaatgaacaccctgcgagccgaggacacggccccgtatattactgtgcgagactaacccgttgcctggttattaccttgactacgttggggccagggaaccctggtcaccgtctcctcacgcctccaccaaacgggcccagtccggttccttcccccgtggcccgccctcgcctccgaggacgccacctccgagacgcacacgccggccctgggctcgcctcggtcaacggacctacgtcaacg

SEQ ID NO: 314975 - DNA, 572 bp, Homo sapiens
  misc_feature: GZ8MTXP02FMZ95.9.78.H01.1.454.CMB.2.raw
  modified_base (278)..(278): a, c, t, g, unknown or other
  misc_feature (278)..(278): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggttcatacatttatcctagtggtgataccatatactacgcagactctgtgaagggccattcaccatcnccaggacaacgccaagaactcactgactttgacaaaatgaacaccctgcgagccgaggacacggcccctatattactgtgcgaagactaacccgttcgccttggttaacttacctgacacgttggggaccagggaaccctggtcaccgtctcctcacgcctaccaaccaacgggcccagtcggtcccttccccgtgccgccctgcctccaggacgccacctccgaagcgaccacgacggccggcccctggggacctggcccttgggacaaacgggaccttacgttcccaaacgg

SEQ ID NO: 314976 - DNA, 574 bp, Homo sapiens
  misc_feature: GZ8MTXP02HO7BK.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggtctggagtgggtttcatacatttatcctagtggtgataccatatactacgcagactctgtgaagggccattcacatctccaggacaacgccaaagaactcactgactttgacaaaatgaaacaccctgcgagccgaggacacggcccctatattactgtgcgaagaacttaacccgttcgacccttggtttaacttaccttgacctacgttcgggggccaaggggaacccctggtccaccgtcctcctcacgccctccaaccaacgggcccagttccggtccttccccctcggccgccctgctccaggcgcaccctccgagacgcacagccggccctgggctcgcccgtaggtccaaaggtacctactttccaag

SEQ ID NO: 314977 - DNA, 553 bp, Homo sapiens
  misc_feature: GZ8MTXP02FQ2UJ.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagaactcactgactttgcaaatgaacaccctgcgagccgaggacacggccccgtatatactgtgcgagataacccgttcgcctggttattaccttgacacttggggcccaggggaaccctggtcaccgtctcctcacgcctccaccgaacgggcccagtccggtcttcccccgtggcccgccctgcctcccgaggacgccacctccgagacgcacacgccggccctgggcctgccctggtacaaggactacttccaacg

SEQ ID NO: 314978 - DNA, 588 bp, Homo sapiens
  misc_feature: GZ8MTXP02G17PH.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccaggacaacgccaagaactcactgactttgcaaatgaaccaccctgcgagccgaggacacggccgtatatactgtgcgaagaactaacccgttcgccctggttacttacctgacacgttggggccagggaaccctggtccaccgtctcctcacgccctacccaccgaacgggcccagtccggtcccttcccccgtggcccgccctgcctccgaggacgccaccgtccgagacgcacgacgccggcccgtggggcctcggccgtgggtaccaaacgggtaccttacttcccgaacgtaccgtatccgacgtcggacggcggctcgggacaacggg

SEQ ID NO: 314979 - DNA, 559 bp, Homo sapiens
  misc_feature: GZ8MTXP02I0YSJ.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgacaggctccagggaagggctgggagtgggtttcatacatttatcctagtggtgataccatatactacgcagactctgtgaagggccgattcacatctccaggacaacgccaagactcactgactttgacaaatgaacaccctgcgagccgaggacacggcccgtatattactgtgcgagactaacccgttcgccttggttattaccttgacacgttggggaccagggaaccctggtcaccgtctcctcacgcctccaccgaacgggcccagtccggtccttccccgtggcccgccctgcctccgagacgccacctccgagacgcacacgccggcccgtgggcctcgccgtcggtacaacggaccttacttccgaacg

SEQ ID NO: 314980 - DNA, 574 bp, Homo sapiens
  misc_feature: GZ8MTXP02FQON6.9.78.H01.1.454.CMB.2.raw
  modified_base (329)..(329): a, c, t, g, unknown or other
  misc_feature (329)..(329): n is a, c, g, or t
  modified_base (488)..(488): a, c, t, g, unknown or other
  misc_feature (488)..(488): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaagaactcactgactttgacaaatgaaccaccctgcgagccgaggacacggcctatattacngtgcgagaactaacccgttcgccccttaggttacttaccttgactacgttggggccagggaaccctggtaccacccgtctcctcacgccctccaccaacgggcccagtccgtccttccccgtgccgccctgcctccaggacgcaccctcgagacgcacncgcggccctggggcctcgccgtggtaccgaacggtacctacgttccgacgtaccgtatcgacgtcgacggcggcgtacggcaacgg

SEQ ID NO: 314981 - DNA, 565 bp, Homo sapiens
  misc_feature: GZ8MTXP02FLQOC.9.78.H01.1.454.CMB.2.raw
  modified_base (278)..(278): a, c, t, g, unknown or other
  misc_feature (278)..(278): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcacatcnccaggacaacgccaagaactcactgactttgcaaatgaacaccctgcgagccgaggacacggccctatatactgtgcgagactaacccgttgccttgttattaccttgactacgttggggccagggaaccctggtccaccgtcctcctcacgccctccgaccaacgggcccacgtccggtcccttcccccgtggcccgccctgcctccgacggacgccaccgtccgagacgccacgacgccggcccctggggcctgcctacggtacaacggacctacttaccgaacg

SEQ ID NO: 314982 - DNA, 533 bp, Homo sapiens
  misc_feature: GZ8MTXP02IP3RT.9.78.H01.1.454.CMB.2.raw
  modified_base (480)..(480): a, c, t, g, unknown or other
  misc_feature (480)..(480): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtcccgccaggctccaggggaaggggctgggagtgggtttcatacatttatcctagtggtgataccatatactacgcagactctgtgaagggccattcaccatctccaggacaacgccaagactcactgactttgcaaatgaacaccctgcgagccgaggacacggccgtatattactgtgcgagactaaccgttcgcctggttactaccttgacacgttggggccagggaaccctggtcaccgtctcctcagcctcaccaaggcccatccggtccttcccctggccgccctgctccaggacncacctccgagacgcacacgccggccgtggctgcctggtcaaggactactcacg

SEQ ID NO: 314983 - DNA, 585 bp, Homo sapiens
  misc_feature: GZ8MTXP02JKYEL.9.78.H01.1.454.CMB.2.raw
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaaggccattcaccatcncaggacaacgcaaagactcactgacttgacaaatgaacaccctgcgagccgaggacacggccgtatattacngtgacgaagactaacccgttgccttaggttacttaccttgacacgttcgggcctagggaacctggtcaccgtctcctcacgcctaccaaccgtaacgggccctacgtccggtcccttcccccgtggcccgccccgtacggtcctaccgacgggaccgccgacccgtccgagacgaccgacgacggccggaccgtcggccgtcgccgtacggtacgaacggtactaccgtacaacg

SEQ ID NO: 314984 - DNA, 662 bp, Homo sapiens
  misc_feature: GZ8MTXP02JDFD9.9.78.H01.1.454.CMB.2.raw
  modified_base (275)..(275): a, c, t, g, unknown or other
  misc_feature (275)..(275): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgaccctgggtccgccaggctccgagggagggctggagtgggttcatacatttatcctagtggtgataccatatactacgcagactctgtgaaggccatcacatcnccaggacaacgccaaagactcactgactttgacaaatcgaacaccctgacgagccgaggacacggcccctatacttactgtcgacgaagacttaacccgttcgacccgttaggttacttacccgtttgaacctacgttcgggggaccctaacgggggtaaaccccgtgggtccctacccggttccctcccgtcgacgcccctacccgaacccgaaaccggggccccaacgttcccggtcccttccccccgtggcccgtccccgtcgccctccgacggacgacccacccgtacccggagaccggaccaaccgacggtcccgggccccgtcggggtacctcggtcccggtaggtaccggaacggtaccctttaaccgttaccgaaacgg

SEQ ID NO: 314985 - DNA, 575 bp, Homo sapiens
  misc_feature: GZ8MTXP02FYI7C.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaaagactcactgactttgcaaatgaacaccctgcgagccgaggacacggcccgtatatactgtgcgagactaacccgttcgccttgtattacctgacacgttgggccaggaaccctgtcaccgtctcctcacgcctccaccgtaacgggcccacgtccggtcccttcccccgtggcccgcccgtcgccctccgacggacgccgacccgtccggacgacgcacgacgccggcccgtgggccgcggtccgtcggtaccgaacggaccttaccgttccgaacgg

SEQ ID NO: 314986 - DNA, 607 bp, Homo sapiens
  misc_feature: GZ8MTXP02I4BFC.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccgattcaccatctccagggacaacgccaaagaactcactgactttgacaaatgaaccaccctgcgagccgaggacacggccgtatattactgtgcgagaactaacccgttcgcccttggttacttacctgactacgttcggggccacgggaccctggtcacccgtctcctcacgccctccaccgaacgggcccatccggtcccttcccccgtggcccgccctgcctccgaggcgccacccgtcggacgacgcacgacggccggcccgtgggcgtcggtccgtcgggtacaaacggtaccttaaccgttcccgaagtaccgtactaaccgtacgtcggacgggccgggtcgtacgggacgaacggg

SEQ ID NO: 314987 - DNA, 697 bp, Homo sapiens
  misc_feature: GZ8MTXP02HQLO4.9.78.H01.1.454.CMB.2.raw
  modified_base (276)..(276): a, c, t, g, unknown or other
  misc_feature (276)..(276): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaggggctggagtggtttcatacatttatcctagtggtgataccatatactacgcagactctgtgaagggccatcacatcnccaggacaacgccaaagactcactgactttgacaaatgaaccaccctgcgagccgaaggacacggcccgtatattactgtgacgaagtacctaacccgttgccttaggtttaacttacccgttagaacctacgtttcggggacccgtaacggggtaaaccccgtgggtacccgtacccggttcctcccgttaccgaccgcccctacccaaacccggaaaccggggcccctaacgtttcccgggttacccctttccccccggtcgggccccgtcccccgtcggtccctcccggaacggaccgacccaaccccgttacccggacggaccgacccgaaccgaacggccccgggtcccccgttggggccctccggcccgttacgggtacccgaaaacgggtacccttaccgtttacccgaaacgg

SEQ ID NO: 314988 - DNA, 622 bp, Homo sapiens
  misc_feature: GZ8MTXP02GAYUJ.9.78.H01.1.454.CMB.2.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaaggggctgggagttgggttcatacatttancctagtggtnatacatatactacgcagactctgtgaagggccattcaccatcnccaggacaacgccaaagactcactgactttgacaaaatgaaaccaccctgcgagccgaggacacggccccgtatatacngtgacgaanactaacccgttcgccttaggttacttaccttgacctacgttcggggaccgacgggaacccgtggtaccgacccgtcctcctcacgccctaccaacccgaacgggcccacgttccggtcccttcccccgtcggcccgccctcgaccgtccgaggaacgccgaacccgtccgaacgacgaccaacgacggcccggtcccgtcgggcctcggcccgtacgggtacgaacgggtaccttaaccgttaccgtaaacgg

SEQ ID NO: 314989 - DNA, 647 bp, Homo sapiens
  misc_feature: GZ8MTXP02GETJJ.9.78.H01.1.454.CMB.2.raw
  modified_base (256)..(256): a, c, t, g, unknown or other
  misc_feature (256)..(256): n is a, c, g, or t
  modified_base (363)..(363): a, c, t, g, unknown or other
  misc_feature (363)..(363): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtgtgataccatatactacgcagactntgtgaagggccgattcaaccatcctccgaggaccaacgccaaagaactcactgactttgacaaaatgaacaccctgcgagccgagacacggcccgtatacttactgngacgaagtactaaccccgttcgccgttagttaactttacctagacctacgttcggggacccaacgggggtaaccctggtccctacccgtccttaccgtcacgccctaccgaaacccgaacggggccccacgttcccggtcccctttcccccggtcggcccgtccccgtcggccctaccgaacgggaccgcccgaacccgtccgaacggacgacaaaccgacggcccggacccgtggggcctccggtaccgtcgggtacaacgggtactacccgttacgaaacgg

SEQ ID NO: 314990 - DNA, 646 bp, Homo sapiens
  misc_feature: GZ8MTXP02I5CEV.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatactatttatcctagtggtgataccatatactacgcagactctgtaggaagggccgattcaccatctccgagggacaacgccaaagaactcactgactttgacaaatgaaccaccctgcgagccgaggacacggctatattactgtgacgagaactaacccgtcgcccttaggttacttacctgactacgttcggggccaacggggacccctggtccaccggttctccctcaccgccctacccgaacccgaacgggcccctacgtcccggttcccttcccccgtcggcccgccctcgcccgtacccgacggacgaccaccccgtccggacgacgaccgaaccgtcggcccgggtcccgtcgggccttccggcccgttacggtaccgaaacgggtaccttaccgttccgaacgtaccgtactccgacgtcggacggccggtacgacggacgaacggg

SEQ ID NO: 314991 - DNA, 576 bp, Homo sapiens
  misc_feature: GZ8MTXP02IFZFP.9.78.H01.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (444)..(444): a, c, t, g, unknown or other
  misc_feature (444)..(444): n is a, c, g, or t
  modified_base (517)..(517): a, c, t, g, unknown or other
  misc_feature (517)..(517): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaggggctggagtggtttcatactattatcctagtgtnatacatatactacgcagactctgtagaaggccatcacatcncgaggacaacgaccaagactcactnacttgacaaatgaaccnccctgcgagccgagacncggacctatattacgngtgacgaatacgttacccgttnccttaggtttacttaccgtgaccgacgttcggggaccgtaacggtaacccgtggtacccaccgtcctcctacncgacctacaaaccgaacggcccaacgttccggtcccttccccgtcgcccgcctccgactccgagaccgcaccncgagacgcacgacgccgccgtcggctaacgccgtacgtacgaagtaccttactaccacg

SEQ ID NO: 314992 - DNA, 586 bp, Homo sapiens
  misc_feature: GZ8MTXP02IBTHS.9.78.H01.1.454.CMB.2.raw
  modified_base (277)..(277): a, c, t, g, unknown or other
  misc_feature (277)..(277): n is a, c, g, or t
  modified_base (358)..(358): a, c, t, g, unknown or other
  misc_feature (358)..(358): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccattcacatcnccaggacaacgccaagactcactgactttgacaaaatgaacaccctgcgagccgagacacggcccgtatatactgtgcganactaacccgttcgccttggttaacttacctgactacgttggggcccgaacgggaaccctggtccaccgtcctcctcacgccctacaaacccgaaacggggccccactccggtcccttcccccgtcggcccgccctcgcctccgacggacgccaccgtccgaagcgccgacgacgccgcccgtcgggctcggccctacggtaccgaacggtacctaccgttaccaacgg

SEQ ID NO: 314993 - DNA, 561 bp, Homo sapiens
  misc_feature: GZ8MTXP02HCSFK.9.78.H01.1.454.CMB.2.raw
  modified_base (276)..(276): a, c, t, g, unknown or other
  misc_feature (276)..(276): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggttcatacatttatcctagtggtgataccatatactacgcagactctgtgaaggccattcacatcnccaggacaacgcaagaactcactgacttgacaaaatgaacaccctgcgagccgaggacacggccctatatactgtgacgaagactaacccgttgccttaggttaacttaccttgactacgttggggaccagggaaccctggtccaccgtctcctcacgccctccaaccgaacgggcccagtccggtccttcccccgtggccgccctgctaccacgacgcacccaccgacgacgacacgacgccggccgtcggcgtcgcgtacgtacgaacgacgtactacgtacg

SEQ ID NO: 314994 - DNA, 551 bp, Homo sapiens
  misc_feature: GZ8MTXP02HAT3E.9.78.H01.1.454.CMB.2.raw
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccaggacaacgccaagaactcactgactttgcaaatgaacaccctgcgagccgaggacacggccgtatattactgtgcgagaataacccgttgcccctggttattacctgacacgttggggccagggaccctggtcaccgtctcctcagcctccaccaaggcccatcgtctcccctgcnccctgctccaggcncacctccgagcgcacagccggccctggggctgcccgtggtacaaacgggtactaccttccgaacggtacctaatccaacgtggacggcgggctcgggacaacggg

SEQ ID NO: 314995 - DNA, 627 bp, Homo sapiens
  misc_feature: GZ8MTXP02HJETV.9.78.H01.1.454.CMB.2.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtcccgccaggctccgaggggaagggctgggagttgggtttcatacatttancctagtggtnataccatatactacgcagactctgtggaagggccattcaccatcncgaggacaacgcaaagaactcactgtacttgacaaatgaaccaccctgcgacgccgaggaccacggcccgtatattacgtgtcgacgaagtacttaaccccgttgaccgttaggtttacttacctgaccgtacgttcgggggaccaggggaaccctggtacccaccgttctcctcacgccctaccgaccgaacgggcccagttcccggtcccttcccccgtcgcccgtacccctgcctaccgacggacgacccaacccgacggacgaacgccaacgacggtccggccccgtggggcctcggcccgttacggtaccgaacggtacccttacgtttaccgaacgg

SEQ ID NO: 314996 - DNA, 743 bp, Homo sapiens
  misc_feature: GZ8MTXP02II2BP.9.78.H01.1.454.CMB.2.raw
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtcccgcaggctccgaggggaaggggctgggagtgggtttcatactatttatcctagtggtanataccatatactacgcagactctgtgaacgggcatcacatcnccaggacaacgccaaagactcactgactttgacaaatcgaaccaccctgacgacgccgaggacacggccgtatacttactgtgacgaagtacgttaacccgttgacccgttaggtttaaccttaccgttagaaccctacggttcgggggacccgtaacgggggtaaccccttggggtaccctacccggttcccttacccgtaccgtaaccgccccttaccccgaaacccggaaaccggggtcccctaacggtttcccgggttcccccttttcccccggcggtcccccgtccccgttagtcccgttaccggaacgggtaccgtaccccaaccccggttacccggaaggaaccgaccgaaaccgaaccgggttccccgggacccccggttgggacccgttcggtaccccggttagggttaacccgaaaacggggttaccctttaacccggtttaccaaacggg

SEQ ID NO: 314997 - DNA, 574 bp, Homo sapiens
  misc_feature: GZ8MTXP02G3DQO.9.78.H01.1.454.CMB.2.raw
  modified_base (355)..(355): a, c, t, g, unknown or other
  misc_feature (355)..(355): n is a, c, g, or t
  modified_base (431)..(431): a, c, t, g, unknown or other
  misc_feature (431)..(431): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccattcaccatctccaggacaacgccaagaactcactgactttgacaaatgaacaccctgcgagccgaggacacggcccctatattacngtgacgagactaacccgttgccttggttattactgacacgttggggccacgggaaccctggtccaccgtctcctcncgcctccaccaacgggcccatccggtccttcccccgtggcccgccctcgcctccgaggacgcaccctccggagacgaccacgacggccggccccgtggggcctcggcctacgggtaccaaaggtacctaccgttccgaaacgg

SEQ ID NO: 314998 - DNA, 594 bp, Homo sapiens
  misc_feature: GZ8MTXP02F229C.9.78.H01.1.454.CMB.2.raw
  modified_base (275)..(275): a, c, t, g, unknown or other
  misc_feature (275)..(275): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtagaggcatcacatcncaggacaacgcaagactcactgacttgacaaatcgaacaccctgcgagccgagacacggccctatatactgtcgacgaagacttaacccgtcgtccgttaggtttaacttaccgttagacctacgttcggggacccaacgggtaaccctggtaccacccgtcctcctacgacgccctaccaaccgaacgggccctacgttcccggtcccttcccccgtgcccgtccctcgcctacgacgacgtccaaccgtcgaagcgacaacgtcgccggtcctggggcctcggccgtacggtacgacggtaccttacgtaccgaacg

SEQ ID NO: 314999 - DNA, 580 bp, Homo sapiens
  misc_feature: GZ8MTXP02GN0DT.9.78.H01.1.454.CMB.2.raw
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtagaagggccattcaccatctccaggacaacgcaaagaactcactgactttgacaaaatgaaaccnccctgcgagccgaggaccacggcccgtaatattacngtgacagactacccgtnccttgttactctgactacgtgggcacggacctgcacgtcctctcncgccctaccaccgacggcccacgttccggtcccttcccccgtggcccncccctcgccctaccgacggacgacccacccgccggagacgaccgaaccacggtcccggcccgtcgggcctgtacccgtggtacccgaaggaccttaccgttccgaaacgg

SEQ ID NO: 315000 - DNA, 595 bp, Homo sapiens
  misc_feature: GZ8MTXP02GWX2R.9.78.H01.1.454.CMB.2.raw
  modified_base (226)..(226): a, c, t, g, unknown or other
  misc_feature (226)..(226): n is a, c, g, or t
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttancctagtgtgataccatatactacgcagactctgtgaaggccgattcacatcncaggacaacgcaagactcactgacttgacaaatgaacaccctgcgacgccgaggacacggcccctatatacngtgcgaagactaacccgttgccgttgttacttacccgttgacctacgttgggggacccaacggggaaccctgggtcccaccggttcctcctcacgccctccgaaccgaacgggccccacgttccggtcccttcccccgtggcccgcccctgcctccgaggacgccaccgtccgagacgccaacgcggcccggcccgtgggcctcggccgtacggtacaacgggtacttacccgttacccgaacgg

SEQ ID NO: 315001 - DNA, 611 bp, Homo sapiens
  misc_feature: GZ8MTXP02IWKHN.9.78.H01.1.454.CMB.2.raw
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaagggctggagtgggtttcatacatttatcctagtggtgataccatatactacgcagactctgtgaaggcatcacatcncaggacacgccaagaacncatgactttgacaaatgaaccaccctgcgagccgagacacggccctatattactgtgcgaagacttaacccgttcgccttaggtttacttacctgactacgttcggggaccgacgggaccctcggtcacccgtctcctcacgccctccgaaacccgtaacggggcccctaacgttccggtccccttcccccgtcggccccgccccgtgccctaccgacgggaccgcccaccccgtccggacgacgaccgaaccgcggcccggccccgtcggggcctccgccgtacggtaccgaaacggtacctaaccgttccaacgg

SEQ ID NO: 315002 - DNA, 570 bp, Homo sapiens
  misc_feature: GZ8MTXP02H15S9.9.78.H01.1.454.CMB.2.raw
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtcccgccaggctccgagggaggggctggagtgggtttcatactatttatcctagtggtnataccatatactacgcagactctgtgaagggccattcaccatctcaggacaacgcaaagactcactgactttgacaaatgaaccacccngcgagccgagacacggccctatatactgncgaanactacccgttcgccttaggttattaccttgacctacgttggggcccacggggaccctggtccaccgtcctcctacncgccctccaccgaacggcccagttcccgtccttcccccgngcccgcctcgctccgaggcnccacctaccgagacgcaacgngcccggtccctggggcctcggtcctacggtacaacggtacctacttaccaacg

SEQ ID NO: 315003 - DNA, 575 bp, Homo sapiens
  misc_feature: GZ8MTXP02HNUNI.9.78.H01.1.454.CMB.2.raw
  modified_base (324)..(324): a, c, t, g, unknown or other
  misc_feature (324)..(324): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaaggccattcaccatctcaggacaacgcaagaactcactgactttgcaaatgaacacctgcgagccgaggacacggccgtatattacngtgacgagaataacccgttcgccccttaggttattccttgactcgttggggccacgggaacctggtccaccgtctcctcacgcctccaccgaacgggcccacgtccggtccttcccccgtggccgcccctgcctcccgaggacgtccacccgtccggagacgcacgacggccgccccgtgggcctgccgtggtacaacggtcctacgttccacgtacgtactccgacgtcgacggcggcgtcggacacggg

SEQ ID NO: 315004 - DNA, 586 bp, Homo sapiens
  misc_feature: GZ8MTXP02JM6ZN.9.78.H01.1.454.CMB.2.raw
  modified_base (354)..(354): a, c, t, g, unknown or other
  misc_feature (354)..(354): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccattcacatctccaggacaacgccaagaactcactgactttgacaaatgaaacaccctgcgagccgagacacggcccgtatattacngtgacgagactaacccgttcgccttggttaacttaccgttgacctacgttcggggacccgacgggaacccgtggtccaccgtcctccctcacgcctccaccgaacgggcccacgtccggtcccttcccccgtgcccgcccgtcgccgtcccaggacgccacccgtccgagacgacaccgacgccggcccgtggcctcgccgtacggtacgaacggtacctaccttacgaacg

SEQ ID NO: 315005 - DNA, 592 bp, Homo sapiens
  misc_feature: GZ8MTXP02JBS4Z.9.78.H01.1.454.CMB.2.raw
  modified_base (325)..(325): a, c, t, g, unknown or other
  misc_feature (325)..(325): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccaggacaacgccaaagaactcactgactttgacaaaatgaaaccnccctgcgagccgaggacacggccccgtatattactgtgcgagactacccgttgccttggttattaccttgacctacgttcggggccaagggaaccctggtccaccgtctcctcacgccctccaaccgaacgggcccagtccggtcccttcccccgtggcccgccctgcctccgaggacgccaacccgtccggagacgccacgacggtccggccccgtggggcctcggcccgtgggtacccaaaaggtcccttaaccttaccgaacgg

SEQ ID NO: 315006 - DNA, 589 bp, Homo sapiens
  misc_feature: GZ8MTXP02GI6UU.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccgattcaccatctccaggacaacgccaaagactcactgactttgacaaatgaacaccctgcgagccgaggacacggcccgtatatacgtgtgcgaagtactaacccgttcgccttaggttacttaccttgaactacgttgggaccgagggaaccctggtaccaccgtcctcctcacgcctacccaaccgaacgggcccctagtccggttcctcccccgtcgcccgccctcgcctaccgagacgcctacccgaccgagacgacacgacggcccgcccgtggggctcggccgtacggtacgaacgaccttaccgttaccgaag

SEQ ID NO: 315007 - DNA, 718 bp, Homo sapiens
  misc_feature: GZ8MTXP02GDCHQ.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctgggagtgggtttcatacatttatcctagtggtgataccatatactacgcagactctgtgaagggccgattcaccatctccgagggacaacgccaagaactcactgactttgacaaatcgaacacccctgcgagccgaggacacggccgtatattactgtgacgagaactaacccgttcgccccttaggttacttacttgactacgttggggccaggggaaccctgggtccacccgtctcccgtcacgccctacccaccgaaacgggccctaacgttcccggtccctttccccccgtcggcccgtcccctcgcccttaccccgaaggggaccgcccgtaaaccccgttcccgggaaacggaaccggaccgaaccggtaacggggccccgggcccccgttcgggggcccgttcggtccccggttacggggttaccgaaaacggggttaacccttaacccgtttcccgaaaacgtacccggtttaactaacccgtaacggttacggaacgggccgggggaccgttacggggaccgaaaccgggg

SEQ ID NO: 315008 - DNA, 581 bp, Homo sapiens
  misc_feature: GZ8MTXP02IFOLB.9.78.H01.1.454.CMB.2.raw
  modified_base (374)..(374): a, c, t, g, unknown or other
  misc_feature (374)..(374): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccaggaccacgccaagactcactgactttgacaaatgaacaccctgcgagccgaggacacggccccgtatattactgtgcgagactaaccccgtncctggttacttacgttgacacgttggggaccagggaaccctggtcaccgtctcctcacgcctccaaccgaacgggcccacgtccggtcccttcccccgtcggcccgcccctcgccgtccgacggacgccacccgtccggagacgccaaccgcgccggccgtcgggctcggacccgtcgggtaccaaagggacctaccttaccgaacg

SEQ ID NO: 315009 - DNA, 682 bp, Homo sapiens
  misc_feature: GZ8MTXP02IH37Y.9.78.H01.1.454.CMB.2.raw
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaggggctggagtgggtttcatactatttatcctagtggtnataccatatactacgcagactctgtgaaggggccatcacatcncaggacaacgcaagactcactgacttgacaaatcgaacaccctgcgagccgagacacggccctaatactactgtgacgaagacttacccgtgcccgttaggtttaaccttaccgttgaacctacggttcgggggacccgtaaacgggggtaacccctgggtaccctacccggttcctcccgtacaccgcccctacgaaaacccgaaaccggggcccctacgttcccgggttccccttcccccggtggcccccgtcccgtcggcccttacccgaaggggtaccacccgtaccccggtaccggaaggaccgaaccgaccggaccgggccccggtcccccggtaggggtccctcggtcccgtaacggggttaccaaaacgggtacctttaaccgtccgtaaaccgg

SEQ ID NO: 315010 - DNA, 636 bp, Homo sapiens
  misc_feature: GZ8MTXP02J1FVW.9.78.H01.1.454.CMB.2.raw
  modified_base (280)..(280): a, c, t, g, unknown or other
  misc_feature (280)..(280): n is a, c, g, or t
  modified_base (322)..(322): a, c, t, g, unknown or other
  misc_feature (322)..(322): n is a, c, g, or t
  modified_base (512)..(512): a, c, t, g, unknown or other
  misc_feature (512)..(512): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatactatttatcctagtggtgataccatatactacgcagactctgtgaagggccatcaccatcncaggacaacgcaagactcactgtactttgacaaatcgaaccnccctgcgagccgaggacacggccccgtatattactgtgcgagacctaacccgttcgccttggttacttaccgttagacctacggttcggggacccgaacggggtaaccctgggtacccacccggtcctcccttcacgtccctacccgacccgaaccgggcccacgtccggtcccttcccccgtcggcccncccgttcgcccgtccgacggacgaccacccgtccggacgaccgacgaccgacggcccggcccgttcgggcccgtcggacccgttacggtaccgaaacggtacccttaaccgtttacccgaacgg

SEQ ID NO: 315011 - DNA, 622 bp, Homo sapiens
  misc_feature: GZ8MTXP02GJ4JF.9.78.H01.1.454.CMB.2.raw
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (511)..(511): a, c, t, g, unknown or other
  misc_feature (511)..(511): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggagggctggagtgggttcatacatttactctagtggtgataccatatactacgcagactctgtagaaggcatcacntcnccaggacaacgcaaagacncactgacttgacaaatcgaaaccncccgtgacgacgcccggaaggaccgtaacggcccgttaatacttacgtgtgacgaagtactaacccgtcgccttaggttacttaccgtgactacgtcgggaccacgggaaccctggtcctacccgtcctcctacacgtaccctccgaacccgaacgggcccaacgttccggtcccttcccccgtgcccgtcccncgacctaccgacggacgaccctacccgacgacgcgaccgaccgacggtcccgcccggtacggtccgtcggtacccgtacggtaccgaaccggtaccttaccgtaccgaacg

SEQ ID NO: 315012 - DNA, 591 bp, Homo sapiens
  misc_feature: GZ8MTXP02HCQZI.9.78.H01.1.454.CMB.2.raw
  modified_base (325)..(325): a, c, t, g, unknown or other
  misc_feature (325)..(325): n is a, c, g, or t
  modified_base (468)..(468): a, c, t, g, unknown or other
  misc_feature (468)..(468): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctgggagtgggtttcatacatttatcctagtggtgataccatatactacgcagactctgtagaagggccgattcacatctcgaggacacgcaagaactcactgactttgacaaatgaacaccctgcgagccgagacacggcctatattacngtgacgaagtaacctaacccgttcgccccttaggtttactttacctgactacggttcggggccaacggggtaaccctgggtaccacccgttctccctcacgccctcccaccgacgggcccagtccggtccctccccgtggccncccgtcgcctccgacggcgcctaccgtcgacgacgcacgacggccggcccgtgggctcgcgtcggtacaacggtactaccgtcgacgtacgtactcgacgtcggacgcggcgtcggacgacgg

SEQ ID NO: 315013 - DNA, 662 bp, Homo sapiens
  misc_feature: GZ8MTXP02GAQYL.9.78.H01.1.454.CMB.2.raw
  modified_base (253)..(253): a, c, t, g, unknown or other
  misc_feature (253)..(253): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatctagtggtgataccatatactacgcagactctgtgaagggccattcaccatcnccaggacaacgcaagaactcactgactttgacaaatgaaccacctgcgagccgaggaccacggccgtatacttactggtgacgaagaaacttaaccccggttcgcccccgttggttactttaaccgttgaaccgtaccggttcgggggcccaaacgggggtaaccccttgggtacccacccggttctacccgtcacgtccctacccgaacccgtaaacgggccccacgttcccggtccctttccccccgtcggtcccgtccccttcgcccttaccgacgggacgtcccaccgtcccgacgacgccacgacgccggcccgtgggcctcgccgtggtaccgaaacgggtaccttaccgtaccgaacgtacgtaactcgtacgtcggacggccgggcgtacggacgaacggg

SEQ ID NO: 315014 - DNA, 424 bp, Homo sapiens
  misc_feature: GZ8MTXP02I9V8L.9.78.H01.1.454.CMB.2.raw
  modified_base (411)..(411): a, c, t, g, unknown or other
  misc_feature (411)..(411): n is a, c, g, or t
  modified_base (417)..(424): a, c, t, g, unknown or other
  misc_feature (417)..(424): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgaggggaaggggctgggagtgggtttcatacatttatcctagtggtgataccatatactacgcagactctgtgaagggccgattcacatctcaggacaacgcaaagaactcactgactttgcaaaacatcggtccttccccctggcacccctcctcaagagcacctctcggggcacagccggcctggcccgtgcctggtacaaggactacttccactgtgacgactgagcgggctggacaacggcncatagnnnnnnnn

SEQ ID NO: 315015 - DNA, 590 bp, Homo sapiens
  misc_feature: GZ8MTXP02F202T.9.78.H01.1.454.CMB.2.raw
  modified_base (408)..(408): a, c, t, g, unknown or other
  misc_feature (408)..(408): n is a, c, g, or t
  modified_base (460)..(460): a, c, t, g, unknown or other
  misc_feature (460)..(460): n is a, c, g, or t
  modified_base (561)..(561): a, c, t, g, unknown or other
  misc_feature (561)..(561): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaaagactcactgactttgacaaatgaaccaccctgcgagccgaggacacggccgtatatactgtgcgaagaactaacccgttcgccccttggttacttaccttgactacgttggggccagggaaccctgggtccaccgtcncctcacgccctcccaccgaacgggcccagtccgtcccttcccccgtcggccncccctgcctccgacggacgccacccgtccgagacgccacgacggccggcccgtgggcctcgccgtcggtaccgaaacggtacctacgttccacgacgtacnccgacgtcgacggcggctcggacaacggg

SEQ ID NO: 315016 - DNA, 521 bp, Homo sapiens
  misc_feature: GZ8MTXP02IAN6G.9.78.H01.1.454.CMB.2.raw
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaaggggcgtggaggtgggtttcatactatttatcctagtggtnataccatatactacgcagactctgtgaagggccatcacatcncaggacacgcaaagacncactgactttgacaaatgaaccaccctgcgaggccgaggacacggccctatntacngtgacganactaccgttnccgttgttactctgacagttgggcacggacctgcncgtctctcacncctccaccgacggcccactccgtccctcccgcgcccgcctcgctccnggacncgaccncgacgancacgcgcgccgtggcngccgtgtcgagctactacacg

SEQ ID NO: 315017 - DNA, 594 bp, Homo sapiens
  misc_feature: GZ8MTXP02GNN9D.9.78.H01.1.454.CMB.2.raw
  modified_base (280)..(280): a, c, t, g, unknown or other
  misc_feature (280)..(280): n is a, c, g, or t
  modified_base (363)..(363): a, c, t, g, unknown or other
  misc_feature (363)..(363): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccgattcacatcncaggacacgccaagaactcactgactttgacaaatgaacaccctgcgagccgaggacacggccccgtatattactgtgcgaanactaacccgttcgccttggttacttaccttgacctacgttcggggaccgacgggtaaccctgggtccacccgtcctcctcacgccctccaaccgaaacgggccccacgttccggttcccttcccccgtcggcccgccccttggccctccgacggacgccacccgtccgacgacgccgacgacggccggcccgtgggcctcgccgtggtacaacggccttacgtacctaacg

SEQ ID NO: 315018 - DNA, 627 bp, Homo sapiens
  misc_feature: GZ8MTXP02FYIVF.9.78.H01.1.454.CMB.2.raw
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (523)..(523): a, c, t, g, unknown or other
  misc_feature (523)..(523): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttancctagtggtgataccatatactacgcagactntgtgaggcatcacatcncgaggacaacgccaagactcactgtacttgacaaatcgaacaccctgacgacgccgaggacacggcccgtatattactgtgacgaagtaacgttaacccgtcgaccttaggtttacttaccgttagactacgttcgggggacccacgggtaacccgtgtcccaccgtcctcctcacgaccctccaaccgaaccggcccacgtccggttcccttcccccgnggccccnccgtcgccctaccgaggaccncccgtaacccgcggacgacgacccgaacgaccggcccggtcccgtcggggcccgtcgacccggttcgggtaaccaacgggtaacccttaccgttaccgaaacgg

SEQ ID NO: 315019 - DNA, 620 bp, Homo sapiens
  misc_feature: GZ8MTXP02HGUQV.9.78.H01.1.454.CMB.2.raw
  modified_base (328)..(328): a, c, t, g, unknown or other
  misc_feature (328)..(328): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatactatttatcctagtggtgataccatatactacgcagactctgtgaaggccatcacatctcaggacaacgcaaagactcactgtactttgacaaatcgaaccaccctgcgagccgagaccacggcctaatacttacngtgacgaagtaactaaccgttcgcccttaggttacttacctgtactacggttcgggcccgagggtaaccctggtccaccgtcacctcgctcccaccaccgaacggccctagtcccggttcccttcccccgcggtccccgcccgtcgcccttaccgacgggactacccgacccgtacccgacggacgccaacgccggcccggtcccgtgggcctcggccgttacgggacgaaacggtaccctaccgttaccgacgtaccgtactcgaacgtggacgcggcgtacggacgacgg

SEQ ID NO: 315020 - DNA, 739 bp, Homo sapiens
  misc_feature: GZ8MTXP02HHB3H.9.78.H01.1.454.CMB.2.raw
  modified_base (321)..(321): a, c, t, g, unknown or other
  misc_feature (321)..(321): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgacaggctccgagggaagggctggagtgggtttcatactatttatcctagtggtgataccatatactacgcagactctgtggaacgggccattcacatctcaggacaacgcaagactcactgacttgacaaatcgaaccnccctgcgacgaccgaggaccgacggccccgtatacttactggtgacgaagtacgttaacccgttcgtaccgttggtttaaccttaccgttaggacctaccggtttcgggggacccgtaaacggggtaaccccgttcgggttaccctacccggttccctccccgttccgaacccgtcccccttacccgaaacccggaaacccggggtccccctaaccggttcccggttcccccgttccccccggttcggcccccgtccccgtcgtccccgtaccgacgggaccgccctaaccccgtacccggacggaccgaccgaaaccgacccggggcccgggtcccccggtcggggtacccgtccggtacccggttacgggtaccgtaaaaccggggtaccctttaacccgtttacccgtaaaccgg

SEQ ID NO: 315021 - DNA, 665 bp, Homo sapiens
  misc_feature: GZ8MTXP02GUE1V.9.78.H01.1.454.CMB.2.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagttgggtttcatacatttatcctagtggtnataccatatactacgnagactcgtgtgaagggccattcaccatctccaggacaacgccaaagactcactgactttgacaaatcgaaacnccctgcgacgccgaggaccacggcccctatattacgtgtncgaagtacctacccgttgccttaggtttacttaccgttgactacgttcgggcccgagggaaccctggccaccgtcctcctcgacgccctaccgaaccgacgggccctacgttcccgggttccctttcccccggtcggccccgtaccccttcggacccttcccgacgggaccgacccgtaccccgtcccggaaggaccgcccgaaaccgcgggcccgggcccgttcgggggccttaaccgggcccgttacggggttaccaaaaccggggttaccctttaaaccgtttcccggtaaaccgg

SEQ ID NO: 315022 - DNA, 773 bp, Homo sapiens
  misc_feature: GZ8MTXP02INPGW.9.78.H01.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgcaggctccgagggaagggctggagtggtttcatacatttanctagtggtnatacatatactacgcagactctgtgaagggccattcaccatcctacgaggacaacgccaaagaactcactcgactttcgactaaaatcgaaccacccgtggacgacgccggtaaggacacggaccccgtatacttacgtgtgacgaagtaccgttaacccgttcgcctttaggggtttacctttaccgtagtaaccgtacgtttcgggggacccaaacggggtaaccccttgggtaccccgtaacccggttccttaccccgttacgacccgggtaccccttacccgaaacccccgggaaaaccgggtcccccgtaacgtttaccccggggttcccccttttaccccccgggtcggggtcccccgttacccccgttcgtaccccgttcccggaaacggggtccgtaccccgaaccccgttcccggaaaacggcggtacccaaaacggaccgggccccggggtaccccgttgggggacccttcggggtaccccgtacggggttaacccaagggggtaaccctttaacccggtacgtaaaccgg

SEQ ID NO: 315023 - DNA, 616 bp, Homo sapiens
  misc_feature: GZ8MTXP02GGU42.9.78.H01.1.454.CMB.2.raw
  modified_base (182)..(182): a, c, t, g, unknown or other
  misc_feature (182)..(182): n is a, c, g, or t
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggctccgagggaagggctggagtggttcatacatttatcctagtggtnataccatatactacgcagactctgtgaagggccattcaccatcncaggacaacgccaaagactcactgactttgacaaaatcgaaccaccctgcgagccgagacacggccctatattactgtgcgaagactacccgtcgccttaggttacttaccgtgactacgttcggggaccgacgggaaccctggtccacccgtcctcctcgacgccctccaaccgaaccgggccctacgttcccggttcccttcccccgtcggcccgtcccgtcgcccgtacccgaacgggaccgccgtacccgtccggaacgacgaccgaaccgacggcccggcccgtcgggcctcggcccgttacggtacgaaacggtacctaccgttaccgaacgg

SEQ ID NO: 315024 - DNA, 627 bp, Homo sapiens
  misc_feature: GZ8MTXP02HRSVK.9.78.H01.1.454.CMB.2.raw
  modified_base (210)..(210): a, c, t, g, unknown or other
  misc_feature (210)..(210): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtnataccatatactacgcagactctgtgaagggccattcaccatctccagggacaacgccaagactcactgactttgcaaatgaacacctgcgagccgagacacggccgtatatactgtgcgaagaactaacccgttcgcccctggttattacccttgacacgttggggccacggggtaaccctggtccaccgtcctcctccacgcctcccaccgaacgggcccagtccggttccttcccccgtcggccgccctcgcctccgcggacgccaacccgtccggaacgaggcccaacgaccggccggccccgttcggggcgtccggcccgttacgggttaccgaaacgggtaccttaccgttacccgacgtaaccggtacttaaccgacgtacggacggacgggtcgtcgggacgaacgggg

SEQ ID NO: 315025 - DNA, 724 bp, Homo sapiens
  misc_feature: GZ8MTXP02IBLQI.9.78.H01.1.454.CMB.2.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctggtccgcaggctcgaggagggctggagtggttcatactatttatctagtgtgatacatatactacgcagactctgtgaggcatcacntctcgaggacaacgcaagacncactgacttgacaatacgaaccaccgtgacgagaccggaggaccacggtccgtaatacgttacnggttacgacgtaacgtaacttaacccccggtttcgaccgtttagttttaacttaccgttagaccgtaccgttcgggggacccgtaacgggtaacccgtacggtacccgtaacccgttccgttccctaccgtaccggtcccccttaccgaaccccgtaaaccggggtacccctaaccggtttcccggttcccccttaccccccggttccgggcccctcccccggtcgtacccgtcccggaaacggaccgaccctaaccccggttacccggaaacggaccgtaccgaacccgtaacgggcccggccccggtcggggtccgtaaccggtcccgttacggtaccggaaaacgggtacccgttaacctttacccgaaaccgg

SEQ ID NO: 315026 - DNA, 520 bp, Homo sapiens
  misc_feature: GZ8MTXP02HW1SV.9.78.H01.1.454.CMB.2.raw
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaagggctggagtggtttcatacatttatcctagtgtgataccatatactacgcagactctgtgaagggccattcaccatcnccagggacaacgcaaagactcactgactttgactaaatcgaaacaccctgcgagccgaggacacggccctatattacngtgacganactaccgtncctgttatctnacntggcaggaccngcacgtctcncncgccnccacacggccactcgccttccccgngcncctnctcgagcncacctccgagcgcacgacgccggcccgtcgggctcgccgtcgacgaaggacctaaccttacaacg

SEQ ID NO: 315027 - DNA, 727 bp, Homo sapiens
  misc_feature: GZ8MTXP02FHG7N.9.78.H01.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggagggctggagtggttcatactatttatcctagtggtgataccatatactacgcagactntgtagaagggccattcacatcncgaggacacgcaagactcatgtacttgacaaatcgaaccncccgtgcgagccgagaccacggccctatactactgtcgacgaagtacctacccgttcgaccgttagttaactttaccgttgaaccgttacggttcgggggacccgtaacggggtaacccttgggtaccctacccgtccttcccgtacaccggacccctacccgaaacccggaaccgggaccctaccggttcccggttccccctttcccccggtcgggtcccccgtccccgttcggtacccgttacccggaacgggtaccgtaccccgaaccccggtacccggaaacggaccggttacccgaaaccgggtacccgggccccgggtacccccgggtggggtaccgtccgggtacccgtttacggggtaaacccgaaaacgggttacccttaaacccggtttcccaaaacggg

SEQ ID NO: 315028 - DNA, 585 bp, Homo sapiens
  misc_feature: GZ8MTXP02GCSD9.9.78.H01.1.454.CMB.2.raw
  modified_base (466)..(466): a, c, t, g, unknown or other
  misc_feature (466)..(466): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtagaagggccattcaccatctcagggacaacgccaagaactcactgactttgacaaatgaaccacccctgcgagccgaggacacggccgtatatactgtgacgaagtaactaacccgttcgcccttaggttacttacctgactacgttggggcctaaggggaaccctggtccaccgttctcctcacgccctacccacgaacgggcccagtccggtccttcccccgtggcccnccctgccctccgaggacgaccacccgtccgagacgccacgacggccggcccgtggctcgcgtcggtacaacggtactacgtacacgtactacnccacgngtacggcggtcacggcacgg

SEQ ID NO: 315029 - DNA, 586 bp, Homo sapiens
  misc_feature: GZ8MTXP02FKK67.9.78.H01.1.454.CMB.2.raw
  modified_base (358)..(358): a, c, t, g, unknown or other
  misc_feature (358)..(358): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtggtttcatacatttatcctagtgtgataccatatactacgcagactctgtgaagggccattcacatctcaggacaacgccaaagactcatgactttgacaaaatcgaaccaccctgacgagtccgaggaccacggccccgtatattacgngtgacgaagtaactaaccccgttgaccgttgttaactttacctgaacctacgtttggggacccgtaacgggaacccttggtccacccgttctacccttacacgccctccaaacccgacggccctacgtccgtcccttcccccgtgcccgccctcgctccgaggacnccacctccgaganccagacgccgcccgtggcgtcgccgtcggtcgaacgtactacctcaacg

SEQ ID NO: 315030 - DNA, 706 bp, Homo sapiens
  misc_feature: GZ8MTXP02IQD9E.9.78.H01.1.454.CMB.2.raw
  modified_base (182)..(182): a, c, t, g, unknown or other
  misc_feature (182)..(182): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctcgagggagggctggagttggttcatactatttanctagtgtanatacatatactacgcagactcgtggtaggaacggggcctattccaacctatcctacccgaagggaaccaaccggaccaaagtaacctcacgtagtaactttgaactaaaagtcgaaaccacccgtgacgacgaccgtaggacacggacccgtatatactgtacgacgaagtaccttaacccgttcgtaccgttagtttaacttacgttcgaacgtaccggttcggggacccgtaacggggaacccttcggtaccctaccggttccctaccctacgaccgtcccctacccgaaaccggaaaccgggcccctaacgttcccggttccccttcccccggtggccccgtccccgtacgtcccaccggaaccggaccgcccgtaacccgaccgacgaccgaccaaaccggaccgtccccgggacccgttcgggacctccggtaccgttacggaccgaacggtaccttaaccctcgaaacg

SEQ ID NO: 315031 - DNA, 759 bp, Homo sapiens
  misc_feature: GZ8MTXP02ISWAR.9.78.H01.1.454.CMB.2.raw
  modified_base (156)..(156): a, c, t, g, unknown or other
  misc_feature (156)..(156): n is a, c, g, or t
  modified_base (235)..(235): a, c, t, g, unknown or other
  misc_feature (235)..(235): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttnagtgactactacatgaccgtgggtcccgcaggctccgaggggagggctgggagttggttcatactatttatctagtgtnataccatatactacgcagactctgtaggaacggggcctattccaacctactcctaccgaagggaaccaaaccgaccaaacgaacctcacttgtactttgaactaaagtacgaaccctacccgtgacgacggccgaacggaacgaccggtaccccgttaattactttacgtggtagacggtaacgtaccgtttaacccggttcgtaccgtttaggtttacttaccgttagtaaccgtacgggttcggggacccgtaacgggaaccccgttggtacccgtacccgttcctcccgtaccgaccgtaccctacccgaaccggtaaacccgggtcccctaaccgtttccccggtttcccccttcccccggtccgggaccccgtccccgttacggtccctaccggacggacccgtacccgtaccccgtacggacggaccgaccgaaaccggccgggtcccgggcccggtcggtcccgtcggtcccggttacggtaaccggaacggttacccttaccgttaccgtaaccgg

SEQ ID NO: 315032 - DNA, 694 bp, Homo sapiens
  misc_feature: GZ8MTXP02FGXV6.9.78.H01.1.454.CMB.2.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggttcatacatttatcctagtggtgataccatatactacgcagactcngtgaggcatcacatcncaggacaacgcaagacnactgactttgacaaaatcgaaacaccctgacgacgccgaaggacacggaccccgtatattactggtgacgaagacttaacccggtcgtaccgttaggtttaactttaccgttagaccttaccgggttacgggggaccccgtaacgggggtaaaccccttggggttacccgtacccggtcctccccgttacgaccgtaccccttaccccgaaacccggaaaccggggcccctaacgttcccgggttcccctttaccccccgtggggcccctcccgtcggtccctaccggacggacgacccgtaaccccgtccggaaacggcgacccgaacgaccggccgggtccccgcggggtctaacggtcccgtacgggtaccaacggtaacccttaccgttccgtaaacgg

SEQ ID NO: 315033 - DNA, 676 bp, Homo sapiens
  misc_feature: GZ8MTXP02I462R.9.78.H01.1.454.CMB.2.raw
  modified_base (606)..(606): a, c, t, g, unknown or other
  misc_feature (606)..(606): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggagggctggagtggttcatactatttatctagtggtgataccatatactacgcagactcgtgtaggaacggccattcacatcctaccgaggacaacgaccaagactcactgtactttagactaaatacgaaccacccgtagccgacggaccgtacggaacgaccggtacccctaagttacttacgtgtacggaccgaacgtaaccgttaaccccgttcgtacccgtttagtttaacctttaccgtttcgaacccttaacgggttcggggacccgaaacgggtaccccgttacggtccgtacccggttccctacccgtacgtaccgccctacccgaaacccggaacccggaccctacgttcccgttcccccttcccgtccggaccccgtcccgtcgccgtaccgacgggacnccgaccgtcgagaccgcaacgcgccgaccgtcgacgtcgcgtacgacgacggtacctacgttaccgaacg

SEQ ID NO: 315034 - DNA, 634 bp, Homo sapiens
  misc_feature: GZ8MTXP02I4M7X.9.78.H01.1.454.CMB.2.raw
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (525)..(525): a, c, t, g, unknown or other
  misc_feature (525)..(525): n is a, c, g, or t
  modified_base (553)..(553): a, c, t, g, unknown or other
  misc_feature (553)..(553): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggctcgagggagggctggagttggttcatactatttatctagtgtnataccatatactacgcagactctgtgaagggccatcacatcncaggacacgccaagactcactgacttgacaaatgaaccaccctgcgagccgaggtacacggccgtatacttactgtcgacgaagtacgttacccgttcacccgttagggtttaacttaccgttgaaccctacggttcgggggacccaacgggggaaccccttgggtacccaacccggttccctcccttcgaccgcccctacccaacccggaaaccgggcccctaacgtttcccggtccccctttcccccggnggtccccgccccttgaccctcgaggacncccgaccctccgagaccgcaacgcggtccgcccgtgggcctcggtccgtacggtcaaacggtaccttaccgtacgaaacgg

SEQ ID NO: 315035 - DNA, 643 bp, Homo sapiens
  misc_feature: GZ8MTXP02FGLAW.9.78.H01.1.454.CMB.2.raw
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (524)..(524): a, c, t, g, unknown or other
  misc_feature (524)..(524): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgtttcagtgactactacatgacctgggtccgccaggctccgaggggaaggggctggagttgggtttcatactatttatcctagtggtnataccatatacacgcagactngtaggaggcattcacatcncgaggacacgaccaaagaactcactgtactttganaaatnaaccaccctgcgacgccggagaccgacgcccgttatatactgagacgaagtacctaacccgtcacgttagttaacttacgtagactacgttcgggaccgaacgggtaaccgtgttacccgacccgtcctcctacgacctcccacccaaaccgggacgaccctcgttaccggttccccttacccccggtgcccctaccccggtcnccgtacgacggctaccgaccgtacggacgacgaccgaccggtaccggcccgtaccggcggtccgtccggtaccggttaacggtaccgtaaccggttaaccttaacccgtccggtaaacg

SEQ ID NO: 315036 - DNA, 705 bp, Homo sapiens
  misc_feature: GZ8MTXP02FO5OF.9.78.H01.1.454.CMB.2.raw
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
tcagtgatacgtctcacgaccggtgctcgatttagtgtgagtagtttgggtttgggtgccgaagttgctggaggtcacggtcaccacgctgctgaggggagtagggtccctgagactctcctgtgcagcctctggattcgcctctggattgacgttcagtgactactacatgacctgggtccgcaggctccgagggagggctaggagttgggttcatactatttactctagtggtnataccatatactacgcaagtctntgtaggaaggccgattcaacactctacgaggacaacgacaagactcatgtactttgactaaatcgaacctacccgtggcgacggccgaaggaaccgacggaccccttaaatattacgtgtacgaacgaacgtaccgttaaacccgtccggtacttacggtttacctttaccgtagtacccgtacggtacgggggtacccgaacggggtaccccgttagggtccctaacccgtcccgttcccgtacctaccgacccccgtacctaaacccggaaaccgggccctaccttccccgggtttcccccttcccccggtcggtccccgtcccgtcggcccgttacccgacggtaccgacctacccgtcggaacacgccaaaccggcggccggtcccggcgggtcgtccggtccggtacgggtaccaacgggtacctaccggtttactaacgg

SEQ ID NO: 315037 - DNA, 686 bp, Homo sapiens
  misc_feature: GZ8MTXP02FHDPL.9.78.H01.1.454.CMB.2.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (597)..(597): a, c, t, g, unknown or other
  misc_feature (597)..(597): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactatacatgacctgggtccncaggctccgagggagggctggagttggttcatactatttanctagtgtanatacatatacacgnagtactnggtagaacgggcctattccacatccacgaggacaacgcaaanactcagtctattgaacaatcgaaaccacctggacgacgccgaaggtaccgacggtcccttaagtacgttactggacgtacgaaacgttaaccgttaccccggttctacggtttagtttaaacttacccttagaacccttacgggttcggggacccgaacggggtaaacccccgttggttaaccctacccggtcctttaccgaccgactacccgtacccaaaaccggaaccgggtccctacggttccccggtttccctcccccgggtggtccccctaccgttcgaacctccggagggtaccccncctaccgacgtagccgaaccgacggtaccggcccgtacggtccgacgtcggtaccgtacggaccgaacgttacctaaccgtccgaaagg

SEQ ID NO: 315038 - DNA, 515 bp, Homo sapiens
  misc_feature: GZ8MTXP01EGTO9.45.79.H02.1.454.CMB.2.raw
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
  modified_base (509)..(509): a, c, t, g, unknown or other
  misc_feature (509)..(509): n is a, c, g, or t
tcagacgcgatcgacacgaccggtgctcgatttagtgtcacacgaagggaaagggggtcacaagaggcagcgctctcgggacgtttccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttatgagggcagtaagcggccctnaggggtttcaatcgcttctctggctccaagtctggcaacncggcctccctgacatctctgggctccaggctgagacgaggctgattattactgctggcttcatatgcaggttagtaagttctttgggtgttcgggcggaagggtccaagcttgaccgtcttaggttcagcccaggctcgccccttggtcncttccg

SEQ ID NO: 315039 - DNA, 518 bp, Homo sapiens
  misc_feature: GZ8MTXP01A8Y57.45.79.H02.1.454.CMB.2.raw
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcaccaggcaaagccccaaactcatgatttatgaggcagtaagcggcctcgagggttctaatcgcttcctctggctccaagtctggcacacggcctcctgacatctctggctcaggctgaggacgaggctgattatactgctgctcatatgctaggtagtgttacgtttggtgttcgggcggtaagggacctaagcgtacggaccgttcgttggttccaagccccgaaggctcgcccccgtcggttccgtaacc

SEQ ID NO: 315040 - DNA, 540 bp, Homo sapiens
  misc_feature: GZ8MTXP01EUTU0.45.79.H02.1.454.CMB.2.raw
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcaccaggcaaagcccccaaatcatgatttatgaggcagtaagcggccctcagggggtttctaatcgcttcctctggctccaagtctggcaacacggcctccctgacaatctctgggctcaggctgaggacgaggctgattatactgctgctnatangcaggtagtagttactttgggtgttcgggcgggtaaggggacccaaggccgtggtacccgttccgttagggttccaaggccccaaagggcctcggccccccgttgggttcctaaccg

SEQ ID NO: 315041 - DNA, 493 bp, Homo sapiens
  misc_feature: GZ8MTXP01B2AJV.45.79.H02.1.454.CMB.2.raw
  modified_base (224)..(224): a, c, t, g, unknown or other
  misc_feature (224)..(224): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatgtgggattatactgtctctgtacacagcaccagcaaagcccccaaatcatgattatgaggcagtaagcggcctcgagggtttcaatcgcttcctctggctccaagtctggcaacacggcctccctgacaatctctggctcagctgagacgagctgattattangctgctcattangcgtaggtagtgttgttggtcgtcggcggacgacgagcgtacgccgttcgttgcaacgccgaacgcctccgccccgtcgttcctcg

SEQ ID NO: 315042 - DNA, 508 bp, Homo sapiens
  misc_feature: GZ8MTXP01DK5EI.45.79.H02.1.454.CMB.2.raw
  modified_base (490)..(490): a, c, t, g, unknown or other
  misc_feature (490)..(490): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtacacagcaccagcaaagccccaaatcatgatttatgagggcagtaagcggccctgagggggtttctaatcgcttcctctggctccaagtctggcaacacggcctccctgacaatctctggctcagctgaggcgaggctgatatactgctgctcatatgctaggtagtagttactttggtgttcggcgggtaggaccaagctcggacgttcgttagggttcaagcccaaggcncgcccctcggttctaacc

SEQ ID NO: 315043 - DNA, 491 bp, Homo sapiens
  misc_feature: GZ8MTXP01BP3CE.45.79.H02.1.454.CMB.2.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactggaaccngcagtgatgtgggattatactgtctctgtaccaangcaccagcaaacgcccccaaatcatgatttangaggcagtaagcgcctgagggtttctaatcgcttctctggctcaagtctggcaacacggcctcctgacatctctggctccagctgaggacgagctgattntatgntgctnatagngngtagtagtgttcgttggtcgtcggcggaggacagcgtacgtcgttcgttgcgaacgcccgtaagcctccgccccgtcgttctc

SEQ ID NO: 315044 - DNA, 515 bp, Homo sapiens
  misc_feature: GZ8MTXP01APVC6.45.79.H02.1.454.CMB.2.raw
  modified_base (378)..(378): a, c, t, g, unknown or other
  misc_feature (378)..(378): n is a, c, g, or t
  modified_base (481)..(481): a, c, t, g, unknown or other
  misc_feature (481)..(481): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttatgagggcagtaagcggccctcgagggtttctaatcgcttcctctggctcaagtctggcaacacggcctccctgacaatcnctggctcaggctgagcgagctgattatactgctgctcatatgcaggtagtgtacgtttggtgttcggcggtagggacaagcgtagacccgttcgttaggttcnggcccaagggcctcgcccccgtggttcctaaccg

SEQ ID NO: 315045 - DNA, 537 bp, Homo sapiens
  misc_feature: GZ8MTXP01D2CN7.45.79.H02.1.454.CMB.2.raw
  modified_base (265)..(265): a, c, t, g, unknown or other
  misc_feature (265)..(265): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (521)..(521): a, c, t, g, unknown or other
  misc_feature (521)..(521): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacngcaccagcaaacgccccaaatcatgatttatgaggcagtaagcggccagtcgtagggtttctaatcgtccttctctggctccaaagtctggcaacgaccggcctccctgactaatctctgggctccgaggctgagggacgaggctagattattacnggtctgtctcatatgntaaggtagttagttacgtttggtggttcgggcgggttagggaccttaaggtctcgaccggttcttaacgggcacgccgaaggcncgtccccgttggtccc

SEQ ID NO: 315046 - DNA, 540 bp, Homo sapiens
  misc_feature: GZ8MTXP01A0G24.45.79.H02.1.454.CMB.2.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagacgcgatcgacacgaccggtgctcgatttagtgtcacacgaagggaaggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttangagggcagtaagcggccctgaggggtttctaatcgcttcctctggctccaagtctggcaacncggcctccctgacaatctctgggctccaggctgaggacgaggctgattatactgctgctcatatgcaggttagtagttacgtttggtcgttcggcggacgggacctaaaggtttcgaaccgttccgttaagggttcacggccccaaggtcctcgcccccgttcgggtcttaaccgttcccg

SEQ ID NO: 315047 - DNA, 515 bp, Homo sapiens
  misc_feature: GZ8MTXP01CDHQM.45.79.H02.1.454.CMB.2.raw
  modified_base (454)..(454): a, c, t, g, unknown or other
  misc_feature (454)..(454): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataccttgtctctggtacacagcaccaggcaaacgccccaaatcatgatttatgaggcagtaagcggccctgaggggtttctaatcgcttcctctgctccaagtctggcaacacggccctccctgacaatcctctgggctccgaggctggaggacgaggctgattattactgctgctcatatgcgaggttagtagttacgttggtgttcggnggtaggaccaagcgtgccgttccgttggttcaagcccaaggcctcgccccgtggttctccg

SEQ ID NO: 315048 - DNA, 507 bp, Homo sapiens
  misc_feature: GZ8MTXP01EZ10Y.45.79.H02.1.454.CMB.2.raw
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcaccaggcaaacgcccccaaactcatgatttatgaggcagtaagcggccctcaggggtttctaatcgcttcctctggctcaagtctggcaacacggcctcctgacaatctctggctccaggctgaggacgaggctgattatactgctgctcatatgcaggtagtagtactttggtgttcggnggagggaccaagctgaaccncgttaggcaagccaaggcctcgccccgtcgttctaacc

SEQ ID NO: 315049 - DNA, 505 bp, Homo sapiens
  misc_feature: GZ8MTXP01EQLRR.45.79.H02.1.454.CMB.2.raw
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataactgtctctggtacaanagcaccaggcaaagcccccaaaatcatgatttangaggcagtaagcgcctnagggtttcaatcgcttctctggctccaagtctggcaacacggcctccctgacaatctctgggctccgaggctagaggacgaggctgattatactgctgctcatatgcaggttagtagtactttggtgttcggcggtaggaccaagcgtgaaccgttcgttggttcaagcccaaggctcgcccctggttctcg

SEQ ID NO: 315050 - DNA, 514 bp, Homo sapiens
  misc_feature: GZ8MTXP01DVJPQ.45.79.H02.1.454.CMB.2.raw
  modified_base (225)..(225): a, c, t, g, unknown or other
  misc_feature (225)..(225): n is a, c, g, or t
  modified_base (468)..(468): a, c, t, g, unknown or other
  misc_feature (468)..(468): n is a, c, g, or t
tcagacgcgatcgacacgaccggtgctcgatttagtgtcacacgaagggaaaggggggtcacaagaggcagcgctctcgggacgtctccaccatggcctgggctctgctgcccctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcacccaggcaaagcccctaaactcatgatttatgagggcagtaagcggccctcaggggtttctaatcgcttctcctggctcaagtctggcaacgacgcctccctgactaatctctgggctcagctgagacgaggctgattatactgctggctcatatgctaggtagttagttatttggtgttcggcggtaaggacgagtcngaccgtcaggttcacgcccaaggctcgccccttcggtccaacgtcc

SEQ ID NO: 315051 - DNA, 547 bp, Homo sapiens
  misc_feature: GZ8MTXP01EDMOB.45.79.H02.1.454.CMB.2.raw
  modified_base (297)..(297): a, c, t, g, unknown or other
  misc_feature (297)..(297): n is a, c, g, or t
  modified_base (420)..(420): a, c, t, g, unknown or other
  misc_feature (420)..(420): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctggtacaacagcaccagacaaacgcccccaaatcatgatttangaggcagtaagcgcctcgagggtttcaatcgcttcctctggctccaagtctggcaacaccggcctcctgacatctctgggctcgagctgaggacgagctgattattactgctgctcatactgntaggtagttagttacgtttgggtggttcgggaacgggaacgggttaccaaaggttccgtaggtacccgttccgttacgggttccaacggcccctaagggcctccgcccccgttcgttccgtaacccg

SEQ ID NO: 315052 - DNA, 530 bp, Homo sapiens
  misc_feature: GZ8MTXP01D7DL3.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatacttgtctctgtaccanagcaccagcaaacgccccaaatcatgatttatgaggcagtaagcgcctgagggtttcaatcgcttcctctgctccaagtctggcaacacggccctccngacaatctcgtggctccgaggctggaggacgagctgattattacngctgtctcatatgctaggtagtagttacgttggtcgttcgggngggtaggaccgaagttcgtcgtaacccgttcgttaggttccaaggcccgaaggcccgtccgcccccgttcggttcctaacccg

SEQ ID NO: 315053 - DNA, 530 bp, Homo sapiens
  misc_feature: GZ8MTXP01A2D28.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcaccaggcaaagcccccaaatcatgatttatgaggcagtaagcggccctgaggggtttctaatcgcttcctctggctccaagtctggcaacacggccctccctgacaatctctggctcaggctgaggacgaggctagattattactgctgtctcgatatgctaggtagtgtacgtttggtcgttcgggcggtagggaccaagttcgtacggccgttcgttaggttccaagtcccaaggtcctcgcccctcggttctaacccg

SEQ ID NO: 315054 - DNA, 539 bp, Homo sapiens
  misc_feature: GZ8MTXP01A2C3C.45.79.H02.1.454.CMB.2.raw
  modified_base (261)..(261): a, c, t, g, unknown or other
  misc_feature (261)..(261): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctctgcactggaaccagcagtgatgttgggattataacttgtctctggtaccanagcaccaggcaaagcccccaaatcatgatttatgaggcagtaagcggccctgaggggtttcaatcgcttcctctggctccaagtctagggcaacgaccggccctccctgacaatctctgggctcaggctgaggacgagctgattatactgctgctcatatgctaggtagtagttacgtttgggtcggttcgggcggaaggggttacccaaggcgttacggaacccgttcgttaggttccaacggccccaagggcctcggcccccctggttcctaaccc

SEQ ID NO: 315055 - DNA, 547 bp, Homo sapiens
  misc_feature: GZ8MTXP01BUSA1.45.79.H02.1.454.CMB.2.raw
  modified_base (298)..(298): a, c, t, g, unknown or other
  misc_feature (298)..(298): n is a, c, g, or t
  modified_base (524)..(524): a, c, t, g, unknown or other
  misc_feature (524)..(524): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggtattttagtttgtctctggtaccaacaacacccggcgaacgccccaaataatcattanaggacactaagcgcctgggggtttcaagtcgcttctctgctcaagtcctggcaacacggcctaccctgaacaatcctacgtcgggcctccagggctcgaggacgaggctgtatttattctgttgcttcatatgcgacggacagcgtacgttgggtcgttcgggcgggaggtaccgtaggttcgaccgtcgtaaggttcacgcccgaaggcttcgccccttcggtcnctctcgtcccgcctccttcgtcg

SEQ ID NO: 315056 - DNA, 509 bp, Homo sapiens
  misc_feature: GZ8MTXP01BHMGU.45.79.H02.1.454.CMB.2.raw
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttaggattataaccttgtctcctggtaccaacagcaccaggcaaagcccccaaatcatgatttangagggcagtaagcggcctcgagggtttcaatcgcttcctctggctccaagtctggcacacggcctccctgacaatctctggctccaggctgaggacgaggctgattattactgctgctcatatgctaggtagtagttacgtttgggtgttcgggcggagggaccaagcgtgaccgttcgttagttcaagccaaggctcgcccctggctcc

SEQ ID NO: 315057 - DNA, 531 bp, Homo sapiens
  misc_feature: GZ8MTXP01DPO3A.45.79.H02.1.454.CMB.2.raw
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (447)..(447): a, c, t, g, unknown or other
  misc_feature (447)..(447): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactggaaccagcagtgatgttgggattataaccttgtctctgtacanagcaccagcaaacgcccccaaatcatgatttatgaggcagtaagcggccctcgtagggtttctaatcgcttctctgctcagtctggcacacgcctccngacatctntggctcgagctgagacgngctgattattactgctgctcatagtgcgtaggttaagtgttacgtttggtaggttcggnggtacgggacctaaagcgtagtacccgttccgttaggttcaacggacccgtaacggtcctccgccccctcggttccttaacccg

SEQ ID NO: 315058 - DNA, 559 bp, Homo sapiens
  misc_feature: GZ8MTXP01EXUH2.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatactgtctctgtacacagcaccagcaaacgcccccaaatcatgatttatgaggcagtaagccgcctcgagggtttctaatcgcttcctctgctcagtctggcacacgcctcctgacatctctggctcgaggctcgaggacgaggctagattattactgctgctcatatgacgtaggttagttagttacgtttgggtcgtttcgggcgggtaagggaccctaaaggccgttacgggtaccccgttacgttacgggttccgaacggtaccccgaaacggtccgtcccggttcccccgttcgggttaacccttccccg

SEQ ID NO: 315059 - DNA, 512 bp, Homo sapiens
  misc_feature: GZ8MTXP01D5XNG.45.79.H02.1.454.CMB.2.raw
  modified_base (361)..(361): a, c, t, g, unknown or other
  misc_feature (361)..(361): n is a, c, g, or t
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtcctgggtctcctggacagtcgatcaccatctcctgcactggaaccagcagtgatgttgggattataaccttgtctcctggtaccaacagcaccaggcaaagcccccaaactcatgatttatgaggcagtaagcggccctcagggggtttctaatcgcttcctctgctccaagtctgcaacncggcctcctgacatctctgggctcagctgagcgagctgattatactgctgcttcatatgcagtagtgttacgttggtcgttggcggngggaccaaggctcggccgttccgttgggccaaggccccaaggccncgcccctcgggttctcccg

SEQ ID NO: 315060 - DNA, 651 bp, Homo sapiens
  misc_feature: GZ8MTXP01EM3AK.45.79.H02.1.454.CMB.2.raw
  modified_base (227)..(227): a, c, t, g, unknown or other
  misc_feature (227)..(227): n is a, c, g, or t
  modified_base (517)..(517): a, c, t, g, unknown or other
  misc_feature (517)..(517): n is a, c, g, or t
  modified_base (614)..(614): a, c, t, g, unknown or other
  misc_feature (614)..(614): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtacgaacngctagtgtagttggtagggtaattactacttgtcctcgtacgtaacaacagcccaccgacgacaaacccgaccccaatcatagtaatttagaggaggacgaaggtaacggcccgaccgttagggttacgggtttactaacgtcgttcttccctggtacgtccctaacgaacgttcgtcgaacccaaacgcccgggtcccttacccgtaagaactactccgtcgtcggcctaccgaggtccgtaagggaaccggaggtacggtctaagtaactttaacgttcgcgtacgtntcctataatttagcgacgttaggtttaagttacgtttgtttggggtcgtacgggaagggtaacgacgagttcgtaccgtccgttacgttcggaaccngaacccggtcgtcgcccgttccccgtcgttcctcccg

SEQ ID NO: 315061 - DNA, 581 bp, Homo sapiens
  misc_feature: GZ8MTXP01BJ9Y0.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtacacngcacccaggccaaacgcccccaaactcatgtatttangaggcagtaagccggccctcgtaggggtttctaatcgctttcctcgtggctccaagtctggcaacgcgccctcctgacaatctctgggcctcgaggctggaggacgaggctgtattacttatgctgtctnatagtgcgtaggttagttacgttacgtttgggttcgttcggggcgggaacggaccgtaagccgtacggtacccggttaccgttcgggttacccgaaccggtacccgaacgggtcccgttcccggttcccccgttcggttaacccttccccg

SEQ ID NO: 315062 - DNA, 509 bp, Homo sapiens
  misc_feature: GZ8MTXP01A9ISM.45.79.H02.1.454.CMB.2.raw
  modified_base (259)..(259): a, c, t, g, unknown or other
  misc_feature (259)..(259): n is a, c, g, or t
  modified_base (444)..(444): a, c, t, g, unknown or other
  misc_feature (444)..(444): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatactgtctctgtacangcaccagcaaacgccccaaatcatgatttatgaggcagtaagccgcctcgtagggtttcaatcgcttcctctggctcaagtctgcaacacggcctcctgacatctcgtcggctccgagctgacggacgaggctgattattactgctgctcatatgctaggttagtagttcgtttggtgttcgggnggtacggacaagcgtagccgttcgttagttcaacgcccgaagcctcgcccctggttcctaacccg

SEQ ID NO: 315063 - DNA, 518 bp, Homo sapiens
  misc_feature: GZ8MTXP01AU60D.45.79.H02.1.454.CMB.2.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcacccaggcaaagcccccaaactcatgatttatgagggcagtaagcgggccctcgagggggtttctaatcgcttcctctgctcaagtctggcacacggcctcctgacatctcnggctcgagctgaggacgagctgattatactgctgctcatangcaggtagtagttacgtttggtgttcgggcggtagggaccgaagcgtgtaccgttccgttgggttcaacgcccaaggcctcgcccctcggttctaaccg

SEQ ID NO: 315064 - DNA, 505 bp, Homo sapiens
  misc_feature: GZ8MTXP01DBPE3.45.79.H02.1.454.CMB.2.raw
  modified_base (421)..(421): a, c, t, g, unknown or other
  misc_feature (421)..(421): n is a, c, g, or t
tcagacgcgatcgacacgaccggtgctcgatttagtgtcacacgaagggaaaggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtacaacagcaccaggcaaagcccccaaatcatgatttatgagggcagtaagcggccctcaggggtttcaaatcgcttcctctggctccaagtctggcaaacacggcctccctgacaatctctgggctccaggctgagacgagctgatatatgctgctcatatgngagtagtagtagttgtgtggtggaggacgacgcgtcgtcgttcgttcgttcgaacgaccgaacgcgtcgcccgtccgttcgtcg

SEQ ID NO: 315065 - DNA, 547 bp, Homo sapiens
  misc_feature: GZ8MTXP01C7Y4L.45.79.H02.1.454.CMB.2.raw
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (518)..(518): a, c, t, g, unknown or other
  misc_feature (518)..(518): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaacagtgatgttgggtagtttttagtttgtctcctggtaccaacaacaccccggcgaacgcccccaaataatcatttataggacactaagcggccctcgggggttcaagtcgcttcnctggctccagtctcggcaacncggcctccctgacaatctctgggctccaggctcaggacgaggctgatttattctgtttgctcatatgcagggggaccagcctacgttggggtgttcgggcgggagggtcctagggttcgaccgtctaagggtcagcccaggctcgccccttggccnctcctcgttccccacccttcctcttcgcg

SEQ ID NO: 315066 - DNA, 517 bp, Homo sapiens
  misc_feature: GZ8MTXP01D97S2.45.79.H02.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaanagcacccaggcaaagcccccaaatcatgatttangaggcagtaagcggcctnagggtttcaatcgcttcctctggctccaagtctggcacacggcctcctgacatctctggctcagctgagacaggctgattattacngctgctacatangcaggtagtgtactttggtgttcgggcggtaggggccaaagcgtacgacccgttccgttagggttcaagcccaaggtcctcggccccctgggttcctaacccg

SEQ ID NO: 315067 - DNA, 513 bp, Homo sapiens
  misc_feature: GZ8MTXP01D32GR.45.79.H02.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattanaaccttgtctctggtaccaangaacaccaggcaaagccccaaatcatgatttatgaggcagtaagcggcctcgagggtttcaatcgcttcnctggctcaagtctggcaaacacggcctccctgacaatctctggctcaggctgaggacgaggctgattagttactgactgctcatangctaggtagttagtctttggtgttcgggnggtagggaccaagcgtacgacgttccgnggttcaagcccaaggcctgcccctggttctaaccg

SEQ ID NO: 315068 - DNA, 558 bp, Homo sapiens
  misc_feature: GZ8MTXP01CRFRF.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaanagcaccagacaaacgcccccaaatcatgatttangaggacagtaagccggccctcgtagggtttctaatcgcttcctctggctccaagtctggcaacacggccctccngacatctctgggctcgaggctggaggacgaggctagattatactgctcgntcatatgcgtaggttagtagttacgtttggtacggttcgggcgggtaacgggacctaaggcgttacggacccgttaccgttagggttccgaacgtccccgaaggtccctccggcccccttcgggttccttaacccg

SEQ ID NO: 315069 - DNA, 508 bp, Homo sapiens
  misc_feature: GZ8MTXP01AWNGQ.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtacaacagcacccaggcaaagccccaaactcatgatttatgaggcagtaagcggccctcgaggggtttctaatcgcttcctctggctccaagtctggcaacacgcctccctgacaatctctggctcaggctgaggacgaggctgacttatactgctgctcatatgcaggtagtagtacgttggtgtcggtcggagggttccaagcgtgaccgttcgttggttcaagccgaagctcgcccctcggttcgtaacc

SEQ ID NO: 315070 - DNA, 539 bp, Homo sapiens
  misc_feature: GZ8MTXP01ETX78.45.79.H02.1.454.CMB.2.raw
  modified_base (291)..(291): a, c, t, g, unknown or other
  misc_feature (291)..(291): n is a, c, g, or t
  modified_base (369)..(369): a, c, t, g, unknown or other
  misc_feature (369)..(369): n is a, c, g, or t
  modified_base (415)..(415): a, c, t, g, unknown or other
  misc_feature (415)..(415): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactgaaccagcagtgatgtgggattatacttgtctctgtacaacagcaccagacaaacgccccaaactcatgatttangaggcagtaagcggcctgtagggtttctaatcgcttcctctggctcaagtctggcaacacggccctcctgacaatctntggctccgagctgacggagaggctgattattatgctgctcatatgnaggtagttagttacgtttggtcgttcgggaacggacgggaccaaaggttccgtacgtacccggttaccgttaggttccaacggcccgaaaggtccctcggttcccccctcggttccgtaacccg

SEQ ID NO: 315071 - DNA, 534 bp, Homo sapiens
  misc_feature: GZ8MTXP01AO9KD.45.79.H02.1.454.CMB.2.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgtgggattatactgtctctgtacaacagcaccagcaaagccccaaancatgatttatgaggcagtaagcgccctgtagggtttctaatcgcttcctctggctccaagtctggcaacacggcctccctgacaatctctgggctccgaggctggaggacgaggctgtattatactgctgctcatactgcgtaggtaagtagttacgtttgggtcggttcgggcgggtaacggacctaaggcgtacggtaccgttcgttaggttccaagccccgaagggcctcgcccccgtggttcctaacccg

SEQ ID NO: 315072 - DNA, 585 bp, Homo sapiens
  misc_feature: GZ8MTXP01DIX9A.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattatacttgtctctgtacaacagcaccaggacaaacgacccccaaatcatgtatttatgaggacagtaagccggccctgtaggggtttctaagtcgcttcctcgtaggctaccaagtctggcaaacgaccggtccctcccgtacgactaactcctcgtcgggcctcgacggctaggaggacgagctagattattactgctgctctatatgcgtaggtagttacggttacgtttggtcggttcgggaacgggtacgggaacctaaggcgtacggtaccgttacccgttgggttaccaacggtacccgaacgggtcctcccggttccccgttcggttcctaacccg

SEQ ID NO: 315073 - DNA, 527 bp, Homo sapiens
  misc_feature: GZ8MTXP01BHUJZ.45.79.H02.1.454.CMB.2.raw
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctcctgcactggaaccngcagtgattggtgggattatacttgtctctgtacanagcaccagacaaacgccccaaatcatgtatttangaggacagtacgccgcctgtagggtttctatcgtcttcctctgctcaagtctgcacacggcctccngacatctcgtggctcgagctggacggacgagctagattattactgctgtctactatagtgacgtaggttagtagttacgtttggtcggttcgggcgggaacggactaaggcgtacgacccgttcgttagttcgaacgccgaaggcctcgccccgtggttcctaaccg

SEQ ID NO: 315074 - DNA, 510 bp, Homo sapiens
  misc_feature: GZ8MTXP01DSN1K.45.79.H02.1.454.CMB.2.raw
  modified_base (225)..(225): a, c, t, g, unknown or other
  misc_feature (225)..(225): n is a, c, g, or t
  modified_base (313)..(313): a, c, t, g, unknown or other
  misc_feature (313)..(313): n is a, c, g, or t
  modified_base (401)..(401): a, c, t, g, unknown or other
  misc_feature (401)..(401): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgttgggattataacttgtctctgtacaacagcaccagcaaagcccccaaatcatgatttatgaggcagtaagcggccctnagggtttcaatcgcttcctctggctccaagtctggcaacacgcctcctgacaatctctgggctcaggctgagcgaggctgattatacngctgctcatatgcaggtagtagttctttgggtgttcgggcggtagggacaagcgtaggaccgttcgttagttcgcgacccgaagcctcgccccttcggttcgtaacccg

SEQ ID NO: 315075 - DNA, 515 bp, Homo sapiens
  misc_feature: GZ8MTXP01EVP32.45.79.H02.1.454.CMB.2.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtacaacagcaccagcaaagccccaaactcatgatttatgaggcagtaagcgccctcaggggtttctcatcgcttctctggctcccaaagtctggcaaatacggcctccctgaccatctctgggctcaggctgaagacgaggctgattattactggcagcacatatattagtgtttccactcgcgtattcggcggagggtacttaagttgaccgttccgttggttcaagcccaaggctcggcccctcgggttcaaccg

SEQ ID NO: 315076 - DNA, 526 bp, Homo sapiens
  misc_feature: GZ8MTXP01A9V7V.45.79.H02.1.454.CMB.2.raw
  modified_base (260)..(260): a, c, t, g, unknown or other
  misc_feature (260)..(260): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtacangcaccaggcaaacgcccccaaatcatgatttatgaggcagtagcgcctgagggttctaatcgcttctctgctcagtctggcaacacggcctcctgacaatctctggctcgaggctggaggacgaggctgattatactgcgtgtctacatatgacgtaggttaagtagttacgtttgggtcgttcgggcggagggttaccaagcgtggaacccgttcgttggttcaacggcccgaaggtcctccgcccccgtcggttaaccgtcccg

SEQ ID NO: 315077 - DNA, 546 bp, Homo sapiens
  misc_feature: GZ8MTXP01EHWW0.45.79.H02.1.454.CMB.2.raw
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtacacagcaccagcaaagcccccaaatcatgatttatgaggcagtaagcggcctgagggtttctaatcgcttcctctggctccaagtctgggcaacacggcctccctgacaatctntggctccaggctgaggacgagctagattatactgcttgccttanatatgacgtaggttagtacgttagtttgggtcggttcgggaacgggtacggacctaggcgtacggtaccgttcgttacggttaccgaacggacccgaacggtcctcccggttccccgtcggttcctcg

SEQ ID NO: 315078 - DNA, 515 bp, Homo sapiens
  misc_feature: GZ8MTXP01CHECB.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctgtacaacagcaccaggcaaagcccccaaatcatgattatgaggcagtaagcgcctgagggtttcaatcgcttcctctggctcaagtctggcaacacggcctccctgacatctcgtcggctccgaggctaggaggacgagggctgattattactgctgctcatatgcaggttagtagttacgtttggtcgttcgggcggtagggacctaagcgtacgaccgttccgttggttccaagcccaagcctcgcccctcggctaaccg

SEQ ID NO: 315079 - DNA, 502 bp, Homo sapiens
  misc_feature: GZ8MTXP01DB44P.45.79.H02.1.454.CMB.2.raw
  modified_base (225)..(225): a, c, t, g, unknown or other
  misc_feature (225)..(225): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactggaaccngcagtgatgttggattatactgtctctgtacacagcaccagcaaagccccaaatcatgatttatgaggcagtaagcggcctcgagggtttctaatcgcttcctctggctccaagtctggcaacacggccctcctgacatctctggctccagctgagacgagctgattatactgctgctcatntgcaggtagtgtactttggngttcggcggagggttaccaagcgtcgaccgttcgttggttccaagccccaaggcctcgttcccctcgttcctccg

SEQ ID NO: 315080 - DNA, 592 bp, Homo sapiens
  misc_feature: GZ8MTXP01C161F.45.79.H02.1.454.CMB.2.raw
  modified_base (251)..(251): a, c, t, g, unknown or other
  misc_feature (251)..(251): n is a, c, g, or t
tcagacgcgatcgacacgaccggtgctcgatttagtgtcacacgaagggaaagggggggtcacaagaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagntgtctctggtatcagcaacacccaggacaaacgcccccaaactcatcatttatgatgtacaataactcggtaccctcgtaggggtttctctatcgtcttctcctggctccaagtctaggctaagtaccgccctccctgacccatctcgtggcctccaggctagaagtacgaggctagattagttactgcaggctactatatattagttgttccagttcgggtaagttccgggacgggtaacggtaaccgtaaagttcggaacccgttcgtaacgggtcacggccccgaaggtccctaccgtcccccgtccgggtccaccgttcccgttccgttcccccccg

SEQ ID NO: 315081 - DNA, 556 bp, Homo sapiens
  misc_feature: GZ8MTXP01CRXGT.45.79.H02.1.454.CMB.2.raw
  modified_base (415)..(415): a, c, t, g, unknown or other
  misc_feature (415)..(415): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatggttgggattataaccttgtctctggtaccaacagcaccaggacaaacgcccccaaatcatgattatgaggcagtaagcgcctgagggtttctaatcgcttcctctgctcaagtctggcaacacgcctcctgacaatctctggctccagctgaggcaggctgattatatgctgcttcattagngtagtaggttagttagttacgtttggtcggttcgggcgggtaacgggaccgtacggttccgtacggtaccgttccgttacggttaccgaaccggtacccgtaacggtcccgtacccggttcccccgttcgttccgtaaccg

SEQ ID NO: 315082 - DNA, 831 bp, Homo sapiens
  misc_feature: GZ8MTXP01AETC8.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagggggggtcacaagaggcagcgctctcgggacgtctccaccatggcctgggctcttctgctcctcactctcctcactcaggacacagggtcctgggcccagtctgccctgactcagcctgcctccgtgtctgggtctcctggacagtcgatcaccatctcctgcactggaaaccngcgtagtgtagttggttagggtattaacttaccgttgtcctcgtacgtaccaacacgaccaccgagacctaaacccgacccccaactctagtagttactttagagggacggacgtaaggtaccgggccccggtaccccgttacggggttacgggggtttttactaacgtccgttcctttcccgtccggttcggaccttaacccgtaacggttccgtaaccgggaaccctaacccgcccgggtcccccttaccccggtacgaaaccttacgttcccgttaccggtccggggtaccctacccggacgggtccggtaagggaacgggaacggtcgggtactaggttaatttacgtttacgcgttcgtcgggtacctacttaagttggtacgtaaccggttaaggggttaacgttttaaccgggtttagggttttcggggtacggggtttaccgggggcggggaaccgggtaaccgttaacggtccgttaacccgggtaccccgtttcccggttaacgggttacccggaccggtaaaccccgggacgggttccccgttcccccgggccccccgggtttaccgggtccttaaccccggttttccccggg

SEQ ID NO: 315083 - DNA, 537 bp, Homo sapiens
  misc_feature: GZ8MTXP01EAWW3.45.79.H02.1.454.CMB.2.raw
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattatactgtctctgtacacngcaccaggcaaagccccaaatcatgatttangaggnagtagcgcctgagggtttcaatcgcttcctctggctccaagtctgcaacncggccctcctgacaactctcgtgggctcgaggctggaggacgagctagattatactgctgctcatatgacgtaggttaagttagttacgtttgggtcgtttcgggaacggacgggacaaggttcgtacgtaccgttccgttaggttccaacggcccaaggtccctcgcccccgttcgggttccttaacccg

SEQ ID NO: 315084 - DNA, 522 bp, Homo sapiens
  misc_feature: GZ8MTXP01CUEVA.45.79.H02.1.454.CMB.2.raw
  modified_base (223)..(223): a, c, t, g, unknown or other
  misc_feature (223)..(223): n is a, c, g, or t
  modified_base (364)..(364): a, c, t, g, unknown or other
  misc_feature (364)..(364): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctctgcactggaaccngcagtgatgtaggattataacttgtctctgtacaacagcaccagacaaacgccccaaatcatgatttatgaggacagtaagccggccctcgtagggtttctaactcgtcttcctctgctccaagtctgcaacacgcctccngacatctctggctcagctagagacgagctgtattatactgcgtcgctcatagtgcgtaggtagttagttagtttggtgttcggaacggaggaccgtagcgtagtccgttacgttggttacaaggaccccgaaggcctccgccccgtcgttctaacccg

SEQ ID NO: 315085 - DNA, 523 bp, Homo sapiens
  misc_feature: GZ8MTXP01BPX3P.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtacaacagcaccaggcaaagcccccaaatcatgatttatgaggcagtaagcggcctgtagggtttctaatcgcttcctctggctccaagtctggcaacacggccctcctgacatctcgtggcctcaggctggaggacgagctgattattactgctgctcatagtgcgtaggttagtgttacgtttggtgttcgggcggaggacgaagctacggaccgttcgttggttcaacgcccgtaaggcctcggcccctcggttcctaaccg

SEQ ID NO: 315086 - DNA, 536 bp, Homo sapiens
  misc_feature: GZ8MTXP01DT6GN.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtacanagcaccaggcaaagcccccaaatcatgatttangaggcagtaagcgcctgagggtttcaatcgcttcnctgctccaagtctggcacacgccctcctgacatctcgtggctccaggctggaggacgaggctgacttattactgctgctcatatgcaggttaagtagttacgtttgggtgttcgggcggtagggaccgaagcgtcggtaccgttcccgttggttaccaacggtaccccgaaggtccctcgttccccccgttcggttccttaacccg

SEQ ID NO: 315087 - DNA, 677 bp, Homo sapiens
  misc_feature: GZ8MTXP01DOA7I.45.79.H02.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcatcaccntctcctgcactggaaaccngnagtgagttggttaggtattactacttgtctcgtacgtacacacnccaccagacaaaccaccccaactcatagtatttagaggaggacgaggtacggcccggtccgtacggtagggtttactacgtcgtcttcctcgtgtcctaccgtacgtcgtagccaaccgtacccggtcccctcctacgactactctcgtcggtcctcgaggtcgtaggaacggacggtagtcgtagtatttacgttacgtcgtcgttcgtacttactagtagtcgtacgttaaggtttaaacggtttaggtttacggttttggggttacgggttccgggggtaacggggtaacgggttaaccgtaacggttccgtaccggtaacccggttaccgttacggttaccgtaacccggacccgtaacgggtccccgtccccggttcccccgttaaccggttcccgtcccg

SEQ ID NO: 315088 - DNA, 538 bp, Homo sapiens
  misc_feature: GZ8MTXP01EY7VO.45.79.H02.1.454.CMB.2.raw
  modified_base (225)..(225): a, c, t, g, unknown or other
  misc_feature (225)..(225): n is a, c, g, or t
  modified_base (435)..(435): a, c, t, g, unknown or other
  misc_feature (435)..(435): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccngcagtgatgttgggattatactgtctctgtaccaacagcacccaggcaaacgcccccaaatcatgatttatgaggcagtaagcggccctcgagggtttctaagtcgcttcctctgctccaagtctggcaacacggccctcctgacaactctctggctccgaggctggaggacgaggctagattattactgctgctcatatgcagggaccngtctacgttgggtgtcgggcggagggtaccgagggttcgaccgttcgttacggttcgaacggcccgaacggtcccgtcgttcccccgtcggttccgtaacccg

SEQ ID NO: 315089 - DNA, 522 bp, Homo sapiens
  misc_feature: GZ8MTXP01DP2OO.45.79.H02.1.454.CMB.2.raw
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgatgtggattataactgtctctgtacaacagcaccagacaaacgccccaaatcatgatttangaggcagtaagcgcctgagggtttcaatcgctttccnctggctccaagtctgcaacacgcctccctagacaatctctggctccgagctagagacgagcgntatatactgcgtntctntatatgtagtagtagttagttagttggttcggtcgggtcgggtacggacgtacgcgtacgtaccgttaccgttcgttacgaacgaccgaacgcgtccgcccgtccgttcgtccg

SEQ ID NO: 315090 - DNA, 509 bp, Homo sapiens
  misc_feature: GZ8MTXP01D3V1P.45.79.H02.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacngtcgatcaccatctcctgcactgaaccngcagtgatgtgggattatactgtctctgtacanagcaccagacaaacgccccaaatcatgatttatgaggcagtaagcgcctgaggtttcaatgcttctctggctccaagtctggcaacacggcctccngacatctntggctcgngctgagacgagctgattatacngntagctnatangctaggtatagttactttgggtcgttcgggaacggtaggactaagcgtagtaccgttcgttggttccgaacgcccgaagcccgtcgcccccgttcggttctaacccg

SEQ ID NO: 315091 - DNA, 571 bp, Homo sapiens
  misc_feature: GZ8MTXP01EN406.45.79.H02.1.454.CMB.2.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatcctcctgcactggaaccagcagtgatggttgggattataacctgtctctgtaccaanagcaccagacaaacgcccccaaatcatgtatttagngaggnagtaagcggccctgtagggtttctaatcgtcttccnctgctcaagtctagcaaacaccggccctccctagacatctcgtggcctccgagctggaacggacgaggctagtattattactgactgtactcaatgtgacgtaggttaagttaggttaacgttttgggtcggttcgggaacgggtaacggggaccaaagttcgtacggacccgttacgttcggttacaaccggccaacggtccgtcccgcccctcggttcctaacccg

SEQ ID NO: 315092 - DNA, 531 bp, Homo sapiens
  misc_feature: GZ8MTXP01AC755.45.79.H02.1.454.CMB.2.raw
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattgttgggattataaccttgtctcctggtaccaacagcaccaggccaaacgcccccaaatcatgatttangaggcagtaagcgcctcgagggtttacaatcgcttcctctggctccaagtctggcacgacggcctccctgacaatctcgtggctcaggctgaggcgagctgtattatactgctgctcatactgcagggttacgtagttacgtttgggtcgttcggggcggaacgggttaccagcgtacggtaccgttcgttagttcgaacgcccgaagcctcgcccctcggctaaccg

SEQ ID NO: 315093 - DNA, 668 bp, Homo sapiens
  misc_feature: GZ8MTXP01EUCSE.45.79.H02.1.454.CMB.2.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattataacttgtctctgtaccaacngcaccagacaaacgcccccaaatcatgtatttagtggaggataaggtaacggcccgggtcccttacggtagggggttttactaagtccgtcctttccctcgtggtccctccgtaaagttccgtaggaacccaaccgtaccgggcccctacccgttacggaacctaacgttccgtcggttcgggtacccttaccggaagggtccgttagggaacgggtaccggaaggtcctaaggtatttaactaccgtgacttcgtcctagtatagtgacgtaaggttagttacgtttacggtttgggtcggttccggggaaggtaaggttaccgagttacgtcggtaacccgttcgttacggcgaacggcccgaacggtcctcccggacccccgtggttaacccttcccgg

SEQ ID NO: 315094 - DNA, 536 bp, Homo sapiens
  misc_feature: GZ8MTXP01CAHIZ.45.79.H02.1.454.CMB.2.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatacctgtctctgtaccanagcaccaggcaaagcccccaaatcatgatttangaggcagtaagcggcctcgaggggtttctaatcgcttctctggctccaagtctgcaacacggcctcctgacaatctctgggctccaggctggaggtacgaggtctagtattaacttacgtgcgtagtctcatagtgctaggttagtagttacgtttgggtgttcggggcggtagggacctaaaggttcggtaccgtcgttaggttcagtcccaaggtctcgcccttcggtcttaacgttcccg

SEQ ID NO: 315095 - DNA, 515 bp, Homo sapiens
  misc_feature: GZ8MTXP01E43A8.45.79.H02.1.454.CMB.2.raw
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactcttctcactcaggacacagggtcctgggcccagtctgccctgactcagcctgcctccgtgtctgggtctcctggacagtcgatcaccatctcctgcactggaaccagcagtgatgttgggattataacctgtctctggtaacacagcaccaggcaaagccccaaactcatgatttatgaggcagtaagcggccctnaggggtttctaatcgcttcctctggctccaagtctggcaacacggcctccctgacaatctctggctccaggctgaggacgaggctgattatacngctgctcatatgctaggtatgtactttgggtgttcgggcggtaggggaccaaaggctagaccgttccgttggttcaagcccaaggctcgccccctggttctaaccg

SEQ ID NO: 315096 - DNA, 617 bp, Homo sapiens
  misc_feature: GZ8MTXP01DWG0Z.45.79.H02.1.454.CMB.2.raw
  modified_base (258)..(258): a, c, t, g, unknown or other
  misc_feature (258)..(258): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcacttaggacacagggtcctgggcccagtctgccctgactcagcctgcctccgtgtctgggtctcctggacagtcgatcaccatctcctgcactggaaccagcagtgatgtggattatactgtctctgtacangcaccaggacaagcccccaaactcatgattatgaggcagtagcggccctgtagggttctaatcgtcttctcctggctccgaagtctggacaacncggcctaccctgacatctctcggctccgaggctgagggacgaggctagtattattacgtgccttgggccttntattagtgacgtaggtttagttaaggtttccgttttggggtcggttccggggacggggtaacgggtaaccgttaaaggtccgttacggaccccggttacgttaaacggggttccgttaaaccggaaccccggtaaacgggtcccgtttccccgggcccccccgttcgggttaacccttcccgttttcccccgg

SEQ ID NO: 315097 - DNA, 567 bp, Homo sapiens
  misc_feature: GZ8MTXP01CTUI6.45.79.H02.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactggaaccngcagtgatgttgggattataacttgtctctgtacacagcaccaggcaaacgcccccaaatcatgatttangaggcagtagccggcctcgagggtttcaatcgcttcctctggctcaagtctggcaacncggcctccngacatctctggctcgagctgaggacgnggctgattatactgctgctcatatgcgtaggttagttacgttacgtttgggtcggttcgggaacgggtaaggggaccctaaaggttccgtacggtaccggttacccgttagggtttaccgaacccccgtaaagggtcccgttccggcccccgttcgggttccttaaccgtttcccgg

SEQ ID NO: 315098 - DNA, 540 bp, Homo sapiens
  misc_feature: GZ8MTXP01EGI1F.45.79.H02.1.454.CMB.2.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccngcagtgatgttgggattatactgtctctgtacangcaccagcaaacgccccaaatcatgatttangaggcagtagcgcctgaggtttctaatcgcttcctctggctacagtctaggcaacgcggccctcctagacatcctcgtggcctcgagctggacggacgaggtctagattatacngtcggtntctctaatgtgacgtaggttagttagttacgtttggtcggttcgggaacgggtaggaccaaggttcgtacgtaccgttcgttacggttcaacgccgaacgtccgtccgccccgttcggttctaacccg

SEQ ID NO: 315099 - DNA, 597 bp, Homo sapiens
  misc_feature: GZ8MTXP01AH542.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagtttttagtttgtctcctggtaccaacaacaccccggcgaacgcccccaaataatcatttatagggacactaagcggccctcgggggtttcaagtcgcttctctggctccaagtctcggcaacacggccctccctagacaatctctgggctccaggctcaggcgaggctgattatttctgttgctcatatgacaggggggaccagctacgtttggggtgttcggcgggtacgggaccgtagggttacgaccggtccgttaacgggtcacggccccgaaagggtccgtaccggccccccgttcgggttccctaaccgttccttccggttacccctccccttccgtccgttccgtccg

SEQ ID NO: 315100 - DNA, 563 bp, Homo sapiens
  misc_feature: GZ8MTXP01D3L04.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccctgtctggtctcctggacagtcgatcaccatcccctgcactggatccagcggtgtacgtttactgtttttaagatgtctcctggtatcagcaacacccaggacaaacgcccccaaatcatcatttatgatgtacaataatccggcctcgtaggggtttctcatcgtccttctctggctccaaagtctggcaactaccggcctcctgactaatctcgtgggctcgaggctaggaggacgaggctgtattagtactgggctgctcatatgactaggtattagttacgttggtcggttcgggcgggaagggaccaaaggtcgtacggttacccggttcttacgggtcacgaacccgaacggccgttccggtcccccgttcggttccccg

SEQ ID NO: 315101 - DNA, 525 bp, Homo sapiens
  misc_feature: GZ8MTXP01AMH6H.45.79.H02.1.454.CMB.2.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
tcagacgcgatcgacacgaccggtgctcgatttagtgtcacacgaagggaaagggggggtcacaagaggcagcgctctcgggacgtctccaccatggcctgtgctctgctgctcctcactctcctcactcaggacacagggtcctgggcccagtctgccctgactcagcctgcctcgtgtctggtctcctggacagtcgatcaccatctctgcactggaaccngcagtgatgtggattatacttgtctctgacacngcaccagacaacgccccaatcatgattangaggcagtagcggcctgtagggttcatcgtcttctntgctcaagtctggcacgacgcctcctgactatctcgtcgggctccgaggctaggacggacggaggctagtattagttactggctgcttcatcgtgacgtaggtagttggttacgtttgggtggttcgggcgggaggaccaaggcgttcgaccgttccgttacggtccacggtcccgaacgggccttccgtccccgttcggtccc

SEQ ID NO: 315102 - DNA, 549 bp, Homo sapiens
  misc_feature: GZ8MTXP01D17YM.45.79.H02.1.454.CMB.2.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataacttgtctctgtacaanagcaccagcaaacgcccccaaatcatgatttangaggnagtaagcgcctcgagggtttctaatcgtcttcctctggctcagtctgcacacggccctccctgacaatctctggctcgagctgagcgaggctgtattattactgcgtgctcattatgcgtaggttagttagttacgttgggttggttcgggaacggtacgggactaacggttcgtacggtacccgttccgttgggttaccaacggtcccgaacggtcccgtccggcccccttcggttccttaacccg

SEQ ID NO: 315103 - DNA, 558 bp, Homo sapiens
  misc_feature: GZ8MTXP01EYMCJ.45.79.H02.1.454.CMB.2.raw
  modified_base (304)..(304): a, c, t, g, unknown or other
  misc_feature (304)..(304): n is a, c, g, or t
  modified_base (468)..(468): a, c, t, g, unknown or other
  misc_feature (468)..(468): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggattataaccttgtctcctggtaccaacagcaccaggcaaacgcccccaaatcatgatttangaggcaggtaagccggcctgtagggtttctaatcgtcttcctctggctccaagtctggcacacgccctcctgacatctctgggctcgagctggacggacgagctagtattattactgctgtctcatagtgacgtaggttagtacgttagttgggtggttcgggngggtaacgggttacaaggttcgtacggtaccgttcgttaggttccaacggcccgtaaggccctccgttcccccgtcggttccctaacccg

SEQ ID NO: 315104 - DNA, 556 bp, Homo sapiens
  misc_feature: GZ8MTXP01ETPK5.45.79.H02.1.454.CMB.2.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctgtaccanagcaccagcaaacgccccaatcatgatttangaggcagtagccgcctgtaggtttcaatcgcttccntgctacagtctggcacgaccgccctcctagacatctcgtggctcgagntgaggacgaggctagtattagttacgtgtctgtctacaagtatgacgtaggttaagttagttacgtttgggttcggttcggggcgggtaacgggacctaacggttcgtacggtacccgttacgttacgggttcccaacggtccccgtaaggtccctccgcccccgttcggttcctaacccg

SEQ ID NO: 315105 - DNA, 545 bp, Homo sapiens
  misc_feature: GZ8MTXP01AJ634.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatactgtctctgtaccanagcaccaggcaaacgccccaaatcatgatttangaggcagtagcgcctcgngggtttcatcgtcttctctgctccaagtctggcaacncggcctccctgacaatctcgtgggctccgagggctggacggacgagggctgattaatctgctgctcatactgcaggttagtagttacgtttggtggttcgggcggtaacggggaccaaggcgttacggaacccgttccgttacgggttccgaacggccccaagggcccgtcccggcccccgtcggttcctaacccg

SEQ ID NO: 315106 - DNA, 653 bp, Homo sapiens
  misc_feature: GZ8MTXP01CZRCD.45.79.H02.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggccagtctgccctgactcagcctgcctcgtgtctgggtctcctggacngtcgatcaccatctcctgcactggaaccngcagtgatgttgggattatactgtctctgtacaacngcaccagcaaacgccccaatcatgattangaggnagtagcgcctcgtagggttctaatcgtcttcctcgtgctccaagtctagcaaccacggccctcccgtagaccaatctacgtcgggactccgaggcctaggaaggaccgaggtctaggtaatttaacgttacgtggtcgttcgtaccttactaagttaagtcggtacgtaaggtttaacggttaaggtttaccggttttagggtcgggtttacggggtcgggggtaaacgggaccggtaaacgttcccgttacgggaaccccggtttaccggttacgggttacccgaaacgggaccccgtaaacggggtcccccgttaccggttacccccccggtttccgggttaacccgtttaaccccg

SEQ ID NO: 315107 - DNA, 547 bp, Homo sapiens
  misc_feature: GZ8MTXP01CUK52.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtacacagcaccagcaaagcccccaaatcatgatttatgaggcagtaagcgcctgagggtttctaatcgcttcctctggctccaagtctggcaacacgcctccctgacaatctctggctccgagcctagaggacgaggctgattatactgctgctcatatgcgtaggttagtagttacgtttgggtgtttcgggcggtaagggaccctaaaggcgttacggacccgttaccgttaggttaccaacggacccctaaggggtcctcggccccccgttcgggttcccttaacccg

SEQ ID NO: 315108 - DNA, 539 bp, Homo sapiens
  misc_feature: GZ8MTXP01BQO5M.45.79.H02.1.454.CMB.2.raw
  modified_base (258)..(259): a, c, t, g, unknown or other
  misc_feature (258)..(259): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatcctctgcactgaaccagcagtgatgttgggattatactgtctctgtacaacnncaccaggacaaacgccccaaatcatnattangaggcagtaagcggtcctgtagggtttactaatcgtcttcctctggctccaagtctggcaaacgacgccctcctgactatctctggctccgaggctggacgacgagctgattattactgctgctacatatcgngtaggttaagtcgttagtttgggtcgttcgggcgggaacggaccgtaaggcgtacgtacccgttcgttacggacgaacgacccgaacggcctccgccccgtcggttccctaacccg

SEQ ID NO: 315109 - DNA, 518 bp, Homo sapiens
  misc_feature: GZ8MTXP01DOZ9K.45.79.H02.1.454.CMB.2.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtgggattataacttgtctctggtaccaacagcaccaggcaaacgcccccaaatcatgatttangaggcagtaagcgcctgagggtttcaatcgcttcnctgctcagtctgcaacacgcctcctgacatctctggctcaggctcgaggacgagctgattattactgctgctcatatgcgtaggttatagttactttggtgttcgggaacggtaggaccaaggcgtacgaccgttcgttagttaccaagaccccgtaaggccgtccgccccgttggttctaacccg

SEQ ID NO: 315110 - DNA, 559 bp, Homo sapiens
  misc_feature: GZ8MTXP01CY0X9.45.79.H02.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattatacttgtctctgtacacagcaccagcaaacgcccccaaatcatgatttangaggcagtagcgcctcgtagggtttctaatcgtcttcctctggctccagtctgcaacgccggccctcctgacatctcgtgggcctcgaggctaggacggacgaggctgacttattactgcttgcttctatagtgacgtaggttagttagtttacggtttggtagggttcggcgggtaggaaccgtaggcgttacggcccgttacgttcggttccgaacggaccccgtaagggccctccggttccccgttccggttctaaccccg

SEQ ID NO: 315111 - DNA, 538 bp, Homo sapiens
  misc_feature: GZ8MTXP01DV3NQ.45.79.H02.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttagggattataaccttgtctctggtaccaacagcacccaggcaaagcccccaaatcatgatttangaggcagtaagcggccctgaggggtttctaagtcgtcttcctctggctccaagtctggcacacggccctccngactaatctactgggcttcgaggctgaggacaggctgattatactgcgtgtctcactatgacgtaggtaagttagtacgtttggtcgttcgggcggtaaggccaaagcgtaggtcccgttcgttacgttcaacgaccaaggtctccgcccctcggttctaacccg

SEQ ID NO: 315112 - DNA, 523 bp, Homo sapiens
  misc_feature: GZ8MTXP01A6ITK.45.79.H02.1.454.CMB.2.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtacacagcaccaggcaaagcccccaaatcatgatttangaggcagtaagcggcctcgagggtttcaatcgcttcctctggctccaagtctggcaacacggcctccctgacaatctctggctcagctgaggcgaggctagattattactgctgctcatactgctaggtagtagttactttgggtgttcgggcggtagggaccaagttcgtcgtaccgttccgttagggttccaacggccccaaggcctcgccccctgggttcctcccg

SEQ ID NO: 315113 - DNA, 518 bp, Homo sapiens
  misc_feature: GZ8MTXP01AINZ0.45.79.H02.1.454.CMB.2.raw
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataccttgtctctggtaccaacagcacccaggcaaagcccccaaatcatgatttangagggcagtagcggccctgagggtttcaatcgcttcctctggctccaagtctggcaacgacggcctccctgacaatcctctgggctccagggcctggaggacgaggctgtattattctgctgacctnatgtgngagtagtagttgttggttggtggcggacggacgtacgcgtcgtcgttcgttcgttcgcgccgaacgcgtccgcccgtccgttcgtcg

SEQ ID NO: 315114 - DNA, 508 bp, Homo sapiens
  misc_feature: GZ8MTXP01DC05R.45.79.H02.1.454.CMB.2.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctgtacaacagcaccaggcaaacgcccccaaatcatgatttangaggcagtaagcggccctcgtagggtttctaatcgcttcctctggctccaagtctggcaacacggcctcctgacatctctggctcagctgagacgaggctgattatactgctgctcatatgctaggttaagtgttacgtttgggtgttcgggaacggaggaccaagcgttagaccgttccgttgttcaagccaagctcgcccctgctaaccg

SEQ ID NO: 315115 - DNA, 521 bp, Homo sapiens
  misc_feature: GZ8MTXP01EI1VM.45.79.H02.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatactgtctcngtacangcaccagcaaacgccccaaatcatgatttangaggnagtagcgcctgagggtttctaatcgtcttcctctggctcaagtctgcaacacggcctcctgacatctctgggtccagctgaggacgaggctgattatactgtctggctcatangctaggttagttaagttagtttggtagttcgggcggaagggtaccaagtcttcggaaccgtcgttaacggttcacggcccaaggtccttcgccccgttggtccttaacgttccg

SEQ ID NO: 315116 - DNA, 599 bp, Homo sapiens
  misc_feature: GZ8MTXP01DISMA.45.79.H02.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgatcaccatctcctgcactggaaccngcagtgatggttgggattataaccttgtctcgtgtacaacagccaccagacaaacgcccccaaatcatntatttangaggcagtaacgcgcctagtaggtttcaatcgcttcnctgcctcaagtctagccaacgaccggccctaccgtgaactatcctacgtcggctccgaggcctggaacggacgaggccttagattacttacgcgtacgtcgtctactatagtgacgtaggttagttaacgttgtttgggtacggttcgggaacgggtaacgggttaccaaaggttccgtacggtacccgttcgttacggttccgaaccggtacccgaacggtccctcccggttacccccgttcggttccctttaaccccg

SEQ ID NO: 315117 - DNA, 521 bp, Homo sapiens
  misc_feature: GZ8MTXP01AHWUU.45.79.H02.1.454.CMB.2.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataactgtctctggtacacagcaccaggacaaacgccccaaaactcatgtatttatgaggcagtaagccggccctcgaggggtttctaatcgcttccntgctcaagtctggcaacacggcctcctgacatctctgggctcaggctggaggcaggtctagacttagttactgctgctcattagngagtaggtagtgttcgttggtcggtcggaaggacggacgtagcgtacgtccgttcgttcggcaacgccgaacgtcctcccgcccgtcgttctccg

SEQ ID NO: 315118 - DNA, 545 bp, Homo sapiens
  misc_feature: GZ8MTXP01D2S7N.45.79.H02.1.454.CMB.2.raw
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctctgtacangcaccagcaaagccccaaancatgatttatgaggcagtagcgccctcgagggtttctaatcgactttcctcgtggctccaagtctgcaacacggcctcctgacatctcgtggctcaggctggaggacgaggctagagttattactgtctgtctacatagtgacgtaggttaagttacgttacgttttgggtcggtttcgggaacggtacggaccgaagttccgtacgtaacccgttcgttacggacgaacggcccaacggtcctaccgccccgttcggcttaacccg

SEQ ID NO: 315119 - DNA, 556 bp, Homo sapiens
  misc_feature: GZ8MTXP01BA070.45.79.H02.1.454.CMB.2.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctgtacacagcaccagcaaagcccccaaatcatgatttangaggcagtagcgcctgagggttctatcgcttcctctgctcagtctgcacncgcctcctgacatctctgggctcaggctgacggacgagcgtagacttattacgtgctgtctcatagtgcgtaggtagttagtacgttttgggtggtttcgggcgggaagggttacccaaagggttccgttacggacccggttaccgttacgggttaccgaaccggtcccgaaacgggtcccgttcccggcccccgttccgggttccttaaccccg

SEQ ID NO: 315120 - DNA, 563 bp, Homo sapiens
  misc_feature: GZ8MTXP01EACRS.45.79.H02.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctcctgcactggaaccagcagtgatgttgggattatactgtctcngtacacagcaccagacaaacgccccaaatcatgatttangaggcagtagcgcctgtaggttcaatcgtcttcctcgtgcctaccaagtctcggcaaacgaccgccctacctagaacatcctcgtcggcctcgagctaggaacggacgaggctagatttattacgtgccgttgtctactatagtagtagtaggttagttagttacggtttaggttcggtcgggtaacgggtaacggacgtacgttacgtacgtaccgttaccgttcgttacgaacgaccgaacgccgtcccgttcccgtccgttccgtccg

SEQ ID NO: 315121 - DNA, 549 bp, Homo sapiens
  misc_feature: GZ8MTXP01EK9RC.45.79.H02.1.454.CMB.2.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattatacttgtctctgtacangcaccagacaaacgccccaaatcatgatttangaggcagtaagcgcctgtagggtttcatcgcttctctggctcagtctggcacacggcctccngacatctcgtggctcgagctggaggacgagctagtattattactgtctgtctacatactgctaggttagttagttacgtttgggtcgggttcgggaacgggtaggggaccctaaaggttcgtacggtaacccggttcccgttagggccaacggcccgtaacggtcctcccggccccttcgggttcctaacccg

SEQ ID NO: 315122 - DNA, 530 bp, Homo sapiens
  misc_feature: GZ8MTXP01BRJPQ.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (443)..(443): a, c, t, g, unknown or other
  misc_feature (443)..(443): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatacttgtctctggtaccaangcaccaggcaaagcccccaaatcatgatttatgaggcagtagcggcctcgagggtttcaatcgcttcctctggctcaagtctggcacacggcctcctgacatcntggctcagctgaggcgngctgattatactgctgctcatagtgcgtaggtagtacgttagtttgggtggtttcgggnggacgggactaaacggcgtacggaacccggttcgttacgggttcaacggacccgaacggtccgtcgcccccgtcggttcctaacccg

SEQ ID NO: 315123 - DNA, 734 bp, Homo sapiens
  misc_feature: GZ8MTXP01CRBLZ.45.79.H02.1.454.CMB.2.raw
  modified_base (266)..(266): a, c, t, g, unknown or other
  misc_feature (266)..(266): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgatggttagggattataacttgtctctgtaccaacngaccaccagacaaacgacccccaaatcatgtatttagaggagggacaaggtaacggcccggtaccccgtacggtacgggggttttacctaaacgttccggtctttaccccgtccgtacggtcccttaccgaaacggttccgtacgggaaccctaaaccgacccgggtcccttacccccgtagaaccctaacttccgtaccgttcgggcccgtacccgagggccgttaagggaacgggtaccggaggtaccgttaggtaaatttaacgttacgttcggtccttcggtccttaccagttaagtggtacgttaagggttaacgttaaggtttcgttttggggtacgggttcgggaacgggtaaacggggaacctaaacgggttccgttaccgggtaacccgttaccggttagggttcccaacgggaccccgtaacggtccctcccggcccccttaacggttccctaacccg

SEQ ID NO: 315124 - DNA, 564 bp, Homo sapiens
  misc_feature: GZ8MTXP01BDPMS.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattataacttgtctctggtaccaacagcacccaggcaaagcccccaaatcatgatttatgaggcagtagcgcctcgagggttctaagtcgcttcctctggctccaagtctggcaacacggccctcctgacatctctggctcaggctgagacgagctagattatactgtctgtctcatatgcgtaggttaagtagttactttgggtgtttcgggcgggtagggacccgaaaggttccgttacggtacccggttccgttacgggttaccgtaaccggacccgtaaacgggcccttcccgggaccccccttcggggttcccttaacccg

SEQ ID NO: 315125 - DNA, 569 bp, Homo sapiens
  misc_feature: GZ8MTXP01EHW07.45.79.H02.1.454.CMB.2.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
  modified_base (425)..(425): a, c, t, g, unknown or other
  misc_feature (425)..(425): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctcngtacanagcaccagacaaacgccccaaatcatntattatgaggcagtaagcgcctgtaggtttctaatcgcttcctctgctcgaagtctggcaacncggcctcctagacatctctgggctccgaggctaggaacggacgaggtctagacttagttatcgtctgctcatangtcgtaggttagttagttacgtttgggtcggttcgggaacggggtaacggaccgtaaacggttcgttacggtaacccgttaccgttaacgggttaccgaacgaccccgaagggtccctcccggccccgtccgggttctaacccg

SEQ ID NO: 315126 - DNA, 520 bp, Homo sapiens
  misc_feature: GZ8MTXP01CNOVF.45.79.H02.1.454.CMB.2.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctcctgcactgaaccngcagtgatgtggattatactgtctctgtacacagcaccagacaaacgccccaaatcatgattangaggcagtagcgcctgtagggttctaatcgcttcctctgctccagtctgcaacacggcctcctgacatctcgtggctcgagctagacggtacgaggctagtattatactgctgctcatatgacgtaggttagtagttacgttgggtgttcgggcggagggaccaaggcgtacggtcccgttccgttggttccgaacgcccgtaaggcctccggccccctggttaaccctcccg

SEQ ID NO: 315127 - DNA, 547 bp, Homo sapiens
  misc_feature: GZ8MTXP01BKTUK.45.79.H02.1.454.CMB.2.raw
tcagacgcgatcgacacgaccggtgctcgatttagtgtcacacgaagggaaaggggggcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattataaccttgtctctggtaccaacagcaccagacaaacgcccccaaatcatgatttatgaggcagtaagccggccctcgtagggtttctaatcgtcttcctctaggcctccaagtctggcaacgaccggccctccctgactaatctctgggctaccgaggctgaaggacgaggctagtattattactgctgtctacatatgactaggttagtagttacgttggtggttcgggcggtaacggaccgtaagcgtacggaccgttccgttggcaacgcccaagggtcctccggcccctcggttctaacccg

SEQ ID NO: 315128 - DNA, 696 bp, Homo sapiens
  misc_feature: GZ8MTXP01C021M.45.79.H02.1.454.CMB.2.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtggaaccngcagtgatggttagggattatacttgtctcgtgtacacagacaccagacaaacgccccaaatcatgtattagaggaggacgaagtacgccggtccctacggtagggtttactaacgtcgtcctttccgtcgtcggtcctaccgtaagtccgtacgggccaaaccgacccgggtcccttaccccgagaacctaactcgtcgtcgggcctcggaggtcgtagggaacggaccggtggtacctaggttaaactttacgttacgtcgtactcgtacctataagtagtcgtacgttaaggtttaacgttaggttaccgttttggggacggtttccgggggaacgggtaacgggttaacccgtaaggttccgttacgggtacccggttaccggttacgggttacccgaaccgggtaccccgtaagggtccccgttacccgggttaccccccgttgggttaacccctttccccgg

SEQ ID NO: 315129 - DNA, 552 bp, Homo sapiens
  misc_feature: GZ8MTXP01BQYGU.45.79.H02.1.454.CMB.2.raw
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatacttgtctcctgtaccacagcaccaggcaaacgcccccaaatcatgatttatgaggnagtaagcggccctcgaggggtttcaatcgcttcctctggctccagtctggcacacgcctcctgacatctctgggctcgaggctgaggacgaggctagattattactgcttgctcatatgcgtagggttacgttagttaccgtttggtaggttccgggaacgggttaagggacccaaggccgtcgtaaccgttcccgttagggttccaacggaccccgaaggccctccgttcccccgtccggttctaacccg

SEQ ID NO: 315130 - DNA, 547 bp, Homo sapiens
  misc_feature: GZ8MTXP01BKYNK.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctgtaccanagcaccaggcaaacgcccccaaatcatgatttagngaggacagtaagccgcctcgtagggtttcaatcgcttctctggctcaagtctcggcaacaccgggcctccctgacatctactcgggcctcgagggctaggacggacgaggtctaggtatttattacgtgcgttgcttacgattactgctagggtacgtgttacgttggtgtcgggaacggagggcccaagcgtacgcccgttcgttcggttcaacgcccgaaggtctccgccccgtcggcttaacccg

SEQ ID NO: 315131 - DNA, 529 bp, Homo sapiens
  misc_feature: GZ8MTXP01B1E4I.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatactgtctctgtacaacagcaccaggcaaagcccccaaatcatgatttatgaggcagtaagcgcctcaggggtttctaatcgcttcctctggctccaagtctggcaacacggcctccctgacatctctggctcagctgagacgagctgattattactgcgtgtctcatatgcgtaggtagtagttaactttgggtcgtttcgggcgggaacgggaccaagttcgtacgacccgttccgttacggcaacggcccgaacggccgtcgccccctcgggttctaacccg

SEQ ID NO: 315132 - DNA, 611 bp, Homo sapiens
  misc_feature: GZ8MTXP01EGZRI.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcgatcaccatctcctgcactgaaccngcagtgatggtaggattatacttgtctctgtacangcaccagacaaacgccccaaatcatgatttagngagganagtagccgtcctcgtaggtttctaatcgtcttcctctcggctacagtctgccaacncccggtccctcccgtagacattctcgtcggcctcgaggccgtaggaacggtacgaggtctagtatttaacttcgtcgtcgtcgtcttacgtaagtcgtacgacgttaggttaagttaggtttaccgtttggggttcggttacggggaacggggtaacggaaccgtaaggttcgtacggtacccgttacggttcggttacccgaacggtacccgaacggtccctcccggttccccgttaacggttccttaaccccg

SEQ ID NO: 315133 - DNA, 584 bp, Homo sapiens
  misc_feature: GZ8MTXP01BK6IN.45.79.H02.1.454.CMB.2.raw
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcaccaggcaaacgcccccaaatcatgatttangaggacagtaagccggcctcgagggtttctaagtcgcttcctctggctcaagtctggcaacacggcctccctgacatctctggctcgaggctggaggacgnggctgtattattactgctgctcattatgacgtaggtagttagttacgtttgggtacggttcgggcgggtaacgggaccgaaaggttccgttacggtaacccggttaccgttacggggttccaaccgggaccccgtaaacgggtcccgtcccggttcccccccggttcgggttcccttaaccccg

SEQ ID NO: 315134 - DNA, 555 bp, Homo sapiens
  misc_feature: GZ8MTXP01CQ8KS.45.79.H02.1.454.CMB.2.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (370)..(370): a, c, t, g, unknown or other
  misc_feature (370)..(370): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctcngtacacagcaccagacaaacgccccaaatcatgattangaggcagtaagcgtcctgtagggtttcaatcgcttcctctggctcaagtctggccaacaccggcctcctgacaatctcgnggctcgagctgaggacgagcgtgattatactgcgtgctcatagtcgagtaggttaagttgttacgtttgggtcggtttcgggcgggtaacgggacgtaaacggcgttacggacccggttaccgttacggttaccgaacggccccgtaaggcccgtaccggttcccccgttcggttcctaaccccg

SEQ ID NO: 315135 - DNA, 755 bp, Homo sapiens
  misc_feature: GZ8MTXP01ACYR1.45.79.H02.1.454.CMB.2.raw
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtnatgttgggattataacttgtctcctggtaccaacagcacccaggacaaacgcccccaaatcatnatttatgaggnagtaagcggcctcgtaggggtttctaagtcgtcttccctcgtggtcctccgaacgttcgttcgggaaccaaaccgaccgggtccctacccctaggtaccaaacgttccctccgtcggggtccttacccggaacgggtccgttaggggaacgggaccggaggggtaccttaggttaaagtttaactttaaccgttggtacccgttggtaccgttaccgtaactttaaagtcgtaccggttaaaggggtttaacggtttaagggttttaacccggttttgggggttccgggttttaccgggggaaccgggggttaaacggggttaccccgaaaggttccggtaaccgggtaaccccggttaccggtttacgggttacccgaaccggtaccccggaagggtccccgttccccgggttacccccccgttcggggttaaccgtttaacccccg

SEQ ID NO: 315136 - DNA, 527 bp, Homo sapiens
  misc_feature: GZ8MTXP01B9B9C.45.79.H02.1.454.CMB.2.raw
  modified_base (300)..(300): a, c, t, g, unknown or other
  misc_feature (300)..(300): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaacagcacccaggcaaagcccccaaatcatgatttangaggcagtaagcgcctgagggtttcaatcgcttcctctgctccaagtctgcaacacgcctcctgacatctctgggctccgaggctgaggacgngctgattatactgctgtntcatntgctaggttactagttacgtttgggtcgttcgggcgggaagggttcccaaagcctagccgttccgttggttaccaagcccaagggcctcggcccccttcggttcctaaccg

SEQ ID NO: 315137 - DNA, 500 bp, Homo sapiens
  misc_feature: GZ8MTXP01D5VNJ.45.79.H02.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctctggacagtcgatcaccatctcctgcatggaaccngcagtnatgtggattanaactgtctctgtacanagcaccaggcaaagcccccaaatcatgatttatgaggcagtaagcggcctgagggtttctaatcgcttcctctggctcaagtctggcaacacggcctcctgacatctctggctccgagctgagcgaggctgattattacngctgcttcatatgnagttagtagtacgtttgtggttcggcgggaggacaaagcgtgaaccgttcgttagggcaagcccaaggcctcgcccctggttaacctccg

SEQ ID NO: 315138 - DNA, 586 bp, Homo sapiens
  misc_feature: GZ8MTXP01C64TI.45.79.H02.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
  modified_base (458)..(458): a, c, t, g, unknown or other
  misc_feature (458)..(458): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatcctctgcactggaaccngcagtgattggttagggtattataaccttgtctctggtacaacagcaccagacaaacgacccccaatcatgtattanggaggacaggtaagccgtccctacgtagggtttactaacgtcgcctttcctctggctccaagtctggccaacgcggccctcctgaactatcctcgtacggctccgtaggcctaggacggacgagtctagtattacttactgctgtactctagtntgacgttaaggtagttagttcgtttagggtcgttccgggtgggaacggttacgaagccgtacggtacccgttcgttggttaccgccgtaccgtaacggtccctccgccccgtcggttccttaaccccg

SEQ ID NO: 315139 - DNA, 569 bp, Homo sapiens
  misc_feature: GZ8MTXP01ET2GH.45.79.H02.1.454.CMB.2.raw
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatgtgggattatacttgtctctgtaccanancaccagacaaacgccccaaatcatgatttangaggcagtaagccgcctgtagggtttctaatcgcttcctctggctaccaagtctgcaacgaccggtccctccctagaactatcctcgtcgggcctaccgaggcctggaacgggacggtaggtctagtacttaattacgtgcctgtctacatagtcgagtaggtagttacgttagtttgggtcggttcgggaacgggtagggaccgaagttcgtacgaccgttccgttaggttccgaacgccgaacggtcctaccgccccgtggttccctaaccg

SEQ ID NO: 315140 - DNA, 584 bp, Homo sapiens
  misc_feature: GZ8MTXP01EQOOK.45.79.H02.1.454.CMB.2.raw
  modified_base (300)..(300): a, c, t, g, unknown or other
  misc_feature (300)..(300): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacagcaccaggacaaacgcccccaaatcatgatttangaggcagtaagcgcctgtagggttctaatcgtcttcctctgctcaagtctggctaacacgcctcctgacatctctgggctcgagctgaggacgaggctagattagttactgctagtctacatangactaggttagtagttacgtttgggtacggtttcgggaacgggtaacggacccgtaaaggttccgtcggtaacccggttccggttaacgggttacccgaaccggccccgtaaacggggcccttcccgggttcccccgttccgggttaaccctaaccccgg

SEQ ID NO: 315141 - DNA, 485 bp, Homo sapiens
  misc_feature: GZ8MTXP01CXJGC.45.79.H02.1.454.CMB.2.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtcgtggtctctggacagtcatcaccntctctgcatgaacngcagtgntgtggattatactgtcnctgtacanagcaccagacaaacgccccaaatcatgatttangaggcagtaagcgcctcgtaggttcaatcgtcttctctgctacaagtcnggcaacgacgcctcctagacatctctgggctccgagcagagacgagctnattatangtntntntnatatgngtagtagtagttgttgtgtggtggacgacgacgcgtacgtcgttcgttcgcgaacgacgaacgcgtcgccgtcgttcgtcg

SEQ ID NO: 315142 - DNA, 570 bp, Homo sapiens
  misc_feature: GZ8MTXP01AJG1L.45.79.H02.1.454.CMB.2.raw
  modified_base (225)..(225): a, c, t, g, unknown or other
  misc_feature (225)..(225): n is a, c, g, or t
  modified_base (444)..(444): a, c, t, g, unknown or other
  misc_feature (444)..(444): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattataacttgtctctggtaccacagcaccaggcaaacgccccaaatcatgatttatgaggcagtaagcggccctcgtaggggtttctaatcgtctttccctctggctccaagtctcgggcaacaccgggcctccctagacaatcctcgtcgggctccgaggctggaggacgaggctagtattattacgtgcctgctcatatcgngtaggtagttagtacgtttggtcggttcgggaacggaggaccgaagttcgtacggaacccgttcgttacggttccaacggcccgaacggtcccgtccggttcccccgttcggttccgttaaccccg

SEQ ID NO: 315143 - DNA, 538 bp, Homo sapiens
  misc_feature: GZ8MTXP01B3E43.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (353)..(353): a, c, t, g, unknown or other
  misc_feature (353)..(353): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatacttgtctctgtacacancaccagcaaacgccccaaatcatgtattatgaggacagtacgcggcctcgtagggtttctaatcgcttcctctcggctccaagtctgcaacnccggcctccctgacatctcgtggctcgagctggaggacgaggctgtattattactgcgtgctctatagtgcgtaggttaagttagttacgtttggtggttcgggaacgggtacggaccaagcgtcgtccgttccgttaggcgtaacgcccgtaacggcctacccggcccctcggttcctaacccg

SEQ ID NO: 315144 - DNA, 526 bp, Homo sapiens
  misc_feature: GZ8MTXP01D5Y6K.45.79.H02.1.454.CMB.2.raw
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccagcagtgatgttgggattataacttgtctctgtaccanagcaccagcaaacgccccaaatcatnatttangaggnagtagcgcctgaggtttcaatcgcttcntgctcaagtctgcaacacgcctccngacatcntggctcagctgagcgagctgattatactgctgctnatntgcgtaggttacgtgttacgtttggtcggttcgggcggaaggactaaacggttcgtaccggtaccgttcgttaggttccaacggccccgtaaggtccgtcccggttccccgtcggttccttaacccg

SEQ ID NO: 315145 - DNA, 525 bp, Homo sapiens
  misc_feature: GZ8MTXP01AQ7R3.45.79.H02.1.454.CMB.2.raw
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctgtacangcaccaggcaaacgccccaaatcatgatttangaggcagtaacgcgcctgagggtttcngatcgcttcntgctcaaagtctggcaacgacggccctcctgaccntctcgngggctccgaggctaggaggccgaggctagtaattattaccgnggacagtctanatgcgacgacgctagctatcgtaacttgttaaggtcggttcgggacggaacggaccaggcgtcgtaccgtcgtacggccacgtaacccgaacggtcccg

SEQ ID NO: 315146 - DNA, 550 bp, Homo sapiens
  misc_feature: GZ8MTXP01DN8N4.45.79.H02.1.454.CMB.2.raw
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (411)..(411): a, c, t, g, unknown or other
  misc_feature (411)..(411): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccaggtctgccctgactcagcctgcctccgtgtctgggtctcctggacagtcgatcaccatctcctgcactgaacngcagtgatgtggattatacttgtctctgtacanagcaccagcaaacgccccaaatcatnattangaggcagtagcgcctgtagggtttctaatcgcttcctctggctcaagtctggcaacacgcctcctagacaatctcgtggctccgaggctagaggacgaggtctagacttatactgctgctnatatgcgtaggttagtagttacgtttgggtgttcgggcggtaacgggaccaaggttccgtacggtaacccgttccgttacgggttccgaaccggcccgaaacgggtccctcccggcccccgttcgggttccctaacccg

SEQ ID NO: 315147 - DNA, 516 bp, Homo sapiens
  misc_feature: GZ8MTXP01D3Q0N.45.79.H02.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtaccaangcaccaggcaaagccccaaatcatgatttangaggnagtaagcggcctcgagggtttcaatcgcttcctctggctccagtctgcaacncggcctcctgacatctctggctcagctgagcgaggctgatatctgctgctcatntgcaggtagttgtacgtttggtgttcggcgggtagggacctaaaggcgttcggaaccgttccgttgggaccaaggccccgaagccgttcgccccttcggttccgtaacccg

SEQ ID NO: 315148 - DNA, 517 bp, Homo sapiens
  misc_feature: GZ8MTXP01BJGXQ.45.79.H02.1.454.CMB.2.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctctggtacaacagcaccagcaaagcccccaaatcatgatttangaggcagtaagcggcctcgagggtttcaatcgcttctctgctcaagtctggcaacacggcctcctgacatctctgggcctcaggctgacggacgaggctgattatactgctgctcatngcaggttatagttacgtttggtgttcgggaaggagggttaccaaggttcgtacggtacccgttcgttaggttccaacgtcccgaaggctcgccccctggttctcccg

SEQ ID NO: 315149 - DNA, 583 bp, Homo sapiens
  misc_feature: GZ8MTXP01C68A9.45.79.H02.1.454.CMB.2.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (559)..(559): a, c, t, g, unknown or other
  misc_feature (559)..(559): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactggaaccagcagtgatgttgggattatactgtctctgtaccaanagcaccagcaaacgcccccaaatcatgatttatgaggnagtaacgcggcctcgtagggtttactaagtcgcttcctctggctccaagtctggccaaacgccggtaccctcctagactaactcctcgtgggcctcccgaggccgtggaaacggacggaggtacgtaggtaatttagttactcggtacttcggtactactatagttgacgtaagggttagttagttacgtttggtaggttcgggaacgggtaggaccgtagccgtgacccgttcgttaggttccaagcccgaaggtccnccgttccccgtcggttcctaaccg

SEQ ID NO: 315150 - DNA, 610 bp, Homo sapiens
  misc_feature: GZ8MTXP01AOGHN.45.79.H02.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtaccaanagcaccagacaaacgccccaaatcatgatttangaggcagtagcgcctgagggtttcatcgcttcctctgctccaagtctggccaacgaccggccctccctagaccaatcctcgtcgggcctccgaggtcctggacgggacgaggtctaggtatttacgttactggtcctgtcctacaattacgtgtcgtaaggttacgttaggtttacgtttgggttcgggttacgggaacgggtaacggggaccctaaaggttcccgtaacgggtccccgttacccgttagggttcccaacgggccccgtaaaggggtccccttccgggccccccgttgggttcccctaacccgg

SEQ ID NO: 315151 - DNA, 554 bp, Homo sapiens
  misc_feature: GZ8MTXP01AQBW2.45.79.H02.1.454.CMB.2.raw
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgatcaccatctcctgcactggaaccagcagtgattgttgggattatacttgtctctgtacacngcaccagcaaacgccccaaatcatgatttatgaggcagtaagcggccctcgagggtttctaatcgtcttcctctgctcagtcnggcacacgcctccngacatctcgtggctcgaggctagaggagaggctgattatactgctgctcatatgacgaggttagtagttacgtttggtacggtttcgggcggtaacgggaccgtaacggcgtacggtaacccgttcgttaacgggttccaacgggccccgtaaacgggtccttcccggttcccccgtccgggttcctaaccccg

SEQ ID NO: 315152 - DNA, 580 bp, Homo sapiens
  misc_feature: GZ8MTXP01BQ4PE.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactggaaccngcagtgatgttgggattataacttgtctctgtacacagcaccaggcaaacgcccccaaactcatgatttatgagggcaggtaagccggcctcgaggggtttctaatcgtcttcctctcggctccaagtctgggcaaacgaccgggtccctccctgacaattcctcgtgggacctcgaggctggaggacgaggtctgtattatactgcgtgctctatatgtacgtaggttaacgttagttacgtttgggttcggttcgggcgggtaacgggttaccgaagcgtccgtaaccggttccgttagggttccaacggtcccgaacggtccctcggccccccttcgggttaacctcccg

SEQ ID NO: 315153 - DNA, 539 bp, Homo sapiens
  misc_feature: GZ8MTXP01A4Y6C.45.79.H02.1.454.CMB.2.raw
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctggtacacagcaccaggcaaagcccccaaatcatgatttangaggcagtaagcggcctgagggtttctaatcgcttcctctggctccaagtctggcaacncgcctccngacatctctggctccgagctgaggacgaggctgattatactgctgtctcatatgcgtaggttagtagttacgtttgggtcggttcgggaacggtagggacctaaggccgtacggacccgttccgttagggttccaacggccccgtaaggccctccggccccctgggttcctaacccg

SEQ ID NO: 315154 - DNA, 517 bp, Homo sapiens
  misc_feature: GZ8MTXP01AR9TV.45.79.H02.1.454.CMB.2.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggattatactgtctctgtacaacngcaccagcaaacgccccaaatcatgattangaggcagagcgccctgagggtttcaatcgcttcnctgctcagtctggcaacncggccctcctgactaatctctgggctcgagctgaggacgaggctgattatactgctgctcatagtgacagggtattacgttacgtttggtcggttcggcggtacgggaccaaaggcgtacggtacgttcccgttggttcaaccgcccaaggccttccgcccctcggttcctaaccg

SEQ ID NO: 315155 - DNA, 571 bp, Homo sapiens
  misc_feature: GZ8MTXP01ERK4R.45.79.H02.1.454.CMB.2.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatactgtctctgtacacagcaccagacaaacgccccaaactcatgatttangaggcagtaagcgcctcgtagggtttctatcgtcttcctcgtgctccagtctcgcaacgcgccctcctagacactctcgtcggctccgaggctaggacggacgaggctagattatactgtctgtcctnatagtgacgtaggttaacgttagttacgtttgggtcggttcggggcgggtaacgggaccgtaacgttccgtacggtaacccgttaccgttaggttaccgaacggccccgtaacgggccctcccggccccgttccgggttaaccttccccg

SEQ ID NO: 315156 - DNA, 537 bp, Homo sapiens
  misc_feature: GZ8MTXP01BO2P1.45.79.H02.1.454.CMB.2.raw
  modified_base (222)..(222): a, c, t, g, unknown or other
  misc_feature (222)..(222): n is a, c, g, or t
  modified_base (363)..(363): a, c, t, g, unknown or other
  misc_feature (363)..(363): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcacatctctgcactggaaccngcagtgatgtggattatactgtctctgtacacagcaccagcaaacgccccaaatcatgatttatgaggacagtaagccggcccgttcgtagggggtttctaatcgcttcctctggctccaagtctggcacgaccgcctccngacatctctgggcctcgaggcgtgacggtacgaggctagtattattactgctgtactctagtatgacgaggttaagttgttacgtttggtcggttcgggaacggtaggacctaaggcgtacggccgttcgttcgcgaacgccctaagggcctcggccccttcggttcctaaccg

SEQ ID NO: 315157 - DNA, 654 bp, Homo sapiens
  misc_feature: GZ8MTXP01DVALM.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtaggattatacttgtctctgtacanancaccagacaaacgaccccaaactcatgtactttagtggacggacagtaacggccggtcccttacggtagggtttactaacgtcgtctttccgtcgtggtcctaccgtaagtccgttagaaccgaaaccgacccggtacccttacccgtacgaacctaacgttcccgttcgtcgggccttacgaacgggtcctagggaacgggacgtacgtcgttagtaatttacgttacgtggtcttcgtaccttataagttacgtagacgttaagggtttaagttacgtttagggtttggtcggttcgggaacggtaacggaactaggccgtacggtaccgttacggttaggaccgaaccggaccgaacggtccgtcccgccccgttcgggctttccccg

SEQ ID NO: 315158 - DNA, 574 bp, Homo sapiens
  misc_feature: GZ8MTXP01AK45K.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacctgtctctgtacaacngcaccaggcaaacgccccaaatcatgatttangaggcagtagcggcctgtaggtttctaagtcgtcttcctctggcctccaagtctcggctaaacgccggccctccgtagacaatcctcgtcggctccgaggccgtaggacggtacgaggtctagtattaacgttactggctgctcattagtgacgtagggttattagttacgtttggtcggttcggggaacggtagggacccaagttccggtacgtaacccgttcgttacgggcctaacggcccgaaggtccctccggcccccttggttaaccctcccgg

SEQ ID NO: 315159 - DNA, 525 bp, Homo sapiens
  misc_feature: GZ8MTXP01ETAZQ.45.79.H02.1.454.CMB.2.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgancaccatctcctgcactggaaccngcagtgatgttgggattataacttgtctctggtacacagcaccaggcaaacgcccccaaatcatgattangngcagtagcgcctgaggttctaatcgcttctctgctcagtctgcacncgcctccngacanctcnggctcgagctgacggcgaggctagtattattacngtcgtntctactagtagcgtagttaggttagttacgttggttgggtcggtcgggaacgggtacggacgtacgttcgtacgtcttacggttcgcgaacgccgtaacgccgtcccgttcccgtcgttcctcg

SEQ ID NO: 315160 - DNA, 567 bp, Homo sapiens
  misc_feature: GZ8MTXP01C7OL8.45.79.H02.1.454.CMB.2.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatcctcctgcactggaaccngcagtgatgttgggattatacttgctctgacangcaccagcaaacnccccaatcatgtatttangaggcagtagcgcctgagggtttctaatcncttctctgctcagtctgcaacncgtcctccanacatctncggctcgagctagaggcgagtctagattnttacncgtctgctacatacgtgacgtaggttagttaggttacgtttgggtcgggttccgggaacggggtaacgggttaccctaaagggccgttacggtacccgttacggttacggttaccgaacggtaaccccgaagggtccccgtccggttccccgttccgggttccttaacccgg

SEQ ID NO: 315161 - DNA, 532 bp, Homo sapiens
  misc_feature: GZ8MTXP01EGINE.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtaccacagcaccagcaaacgcccccaaatcatgatttatgaggcagtaagcggccctcgagggtttctaatcgcttcctctgctccaagtctggcaacacggcctcctgacaatctctggctcaggctgaggacgaggctgattattactgctgctcatatgctagggttagtagttacgtttggtggttcgggcgggaagggttaccaagttccgtgtacccgttcgttggttccaacgcccgaagggcctcggcccccttgggttcctaaccg

SEQ ID NO: 315162 - DNA, 512 bp, Homo sapiens
  misc_feature: GZ8MTXP01CIO5T.45.79.H02.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (451)..(451): a, c, t, g, unknown or other
  misc_feature (451)..(451): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaacngcaccaggcaaacgcccccaaatcatgatttangaggcagtaagcggccctcgtagggggtttctaatcgtcttcctctggctccaagtctggcaacacggcctccctgacatctctgggctcgaggctggaggacgaggctgattacttactgtcctgcttcatagtgcacgcagtcatgactntagttgtcggcggtaggccaagcttcggaaccctcgtaaggtcacgccgaaggcctcccgg

SEQ ID NO: 315163 - DNA, 586 bp, Homo sapiens
  misc_feature: GZ8MTXP01BMCUD.45.79.H02.1.454.CMB.2.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
  modified_base (443)..(443): a, c, t, g, unknown or other
  misc_feature (443)..(443): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngcagtgatgtgggattataacttgtctctggtacaacagcaccaggcaaacgccccaaactcatgatttangaggacaggtaagccggcctacgtagggggtttctaagtcgtcttcctctggctccaagtctggcaacgacgccctcctgacaatctcgtggctcaggctggaacggtcgaaggtctagtaattattacgtgcgttgtaccttnatagtgacgtaggttagttagtaccggtttggttcggtcgggaacgggtacgggacgaaacgttcgtacggtacccggttacgttcgggttccaacgggcccgtaacggtccgtccggcccccgttcgggttaaccttccccg

SEQ ID NO: 315164 - DNA, 638 bp, Homo sapiens
  misc_feature: GZ8MTXP01EYEOY.45.79.H02.1.454.CMB.2.raw
  modified_base (228)..(228): a, c, t, g, unknown or other
  misc_feature (228)..(228): n is a, c, g, or t
  modified_base (272)..(273): a, c, t, g, unknown or other
  misc_feature (272)..(273): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgactacgtacgacgngacgtagtagtagttgggttagttactactactctctacgtacnncncgcncgcgcgtcgcncncncgcgtaaacctaccttagtacgtttagtagtacggtacgacgtacgtccggtaccgtcgtacgtctacctctcgtctccgtctacgtccgtccgaccgtccgtcgtcgctaccgtcgtcgtacgtcgcgtcgcgtacggcgtcttacgtacgtacgacgtcgtacgtactagtaccgttcttcgtcgtacgttacgtaccgtcgtagttaccgtaggttacgttaacggttcgtacgtcggttaccggttcgggttaccgggttacggtacccggtacgttaccgttaccggttaccggtaaccgtccgtaaccgtcgtacccgttccgtcccgttccgtcccg

SEQ ID NO: 315165 - DNA, 521 bp, Homo sapiens
  misc_feature: GZ8MTXP01AEOL7.45.79.H02.1.454.CMB.2.raw
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
  modified_base (513)..(513): a, c, t, g, unknown or other
  misc_feature (513)..(513): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtacacagcaccagcaaacgccccaaactcatgatttatgaggcagtaagcggccctcgagggtttctaatctcttcctctggctccaagtctggcaacacggcctcctgacaatctcnggctcgaggctgaggcgagctgacttatactgctgctnactatcgagtagtagtacgttgggtgttcgggngggaagggccaaggtcgttggtacccgtcgttacggttcacgccaaggtcctcgccccttcggtccncgttcccg

SEQ ID NO: 315166 - DNA, 537 bp, Homo sapiens
  misc_feature: GZ8MTXP01BK4XY.45.79.H02.1.454.CMB.2.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctgtaccaacagcaccaggcaaacgcccccaaatcatgactttangaggcagtagcggcctcgtagggtttctaatcgtcttccnctggcctccaagtctgcaacacggcctcctgacatctctggctcaggctgaggcgaggctgattntactgctgctcaagtntgcgtaggtagtagttacgttggtaggttcgggcgggtaggacccaagttcgtcggtaccgttccgttggttaccgaacgccccgaagggccctcggcccccgtcgggttcctaaccg

SEQ ID NO: 315167 - DNA, 515 bp, Homo sapiens
  misc_feature: GZ8MTXP01ASF6R.45.79.H02.1.454.CMB.2.raw
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccatctctgcactggaaccagcagtgatgtggattanactgtctctgtacacagcaccagcaaacgcccccaaatcatgatttangaggcagtacgcgccctgagggtttctaatcgtcttctctgctcaagtctggcaacacggcctcctgacaatctctgggcctcgaggctggaggacgaggctagtattaacgtactgctgctcagtatgcgtaggtatagtcgtttggtgttgggcggagggaccagcgtcgtaaccgttcgttacggttcaacgcccgaaggtcctcgcccccgtggttcctaaccg

SEQ ID NO: 315168 - DNA, 718 bp, Homo sapiens
  misc_feature: GZ8MTXP01CC953.45.79.H02.1.454.CMB.2.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaacagcaccagacaaacgcccccaaactcatagtatttagnggaaggacaaggtaacgccgggtccctacggtacgggttttacaacgtcgtactttccctcgtggtcctacctaagtcgtcggaacaaaccgacccgggtccctaccctgtaacctaacgttcctcggtcgggtacctacccggagggtaccttgggaaacgggtaaccggtaggggtccttagggtaaccgtttaattaaccgtcggactaaggtaccctaattaattacttaagtttacgtttaccggtttaacctacggtttacggggtacgtttcggggaccgggtaacgggggaaccttaaagggtttacccggaccggttaccgtacgggttacccgacgttaccccgtaacgggtcccttccggtaccccccgtcgggttaccctaacccggttccgtttccccccgg

SEQ ID NO: 315169 - DNA, 638 bp, Homo sapiens
  misc_feature: GZ8MTXP01DMX7N.45.79.H02.1.454.CMB.2.raw
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgagtggttagggattactaccttgtctctgtaccaananccaccgagacaaacgacccccaaatcatgtattagngaggacagtagccgtcctaggtaggtttcaacgtcgtcttcctctggctaccaagttcctaggccaaccacccgggtaccctaccccgtagaacctaacgtcctacgtcggtcctcgaggccgtagggaacgggaccggagtactaggtaactttacgttacgtgtctcgtacttactaagttacgtgacggtaaggttaggtttacgttacggttttgggtcgggttaccgggaacgggtacgggaactacggacgtacggtaccgttacgcggttaccgcggaacccgtaacgtccgtacccggttcccctaacgggttcttaacccgg

SEQ ID NO: 315170 - DNA, 514 bp, Homo sapiens
  misc_feature: GZ8MTXP01B7PVI.45.79.H02.1.454.CMB.2.raw
  modified_base (485)..(485): a, c, t, g, unknown or other
  misc_feature (485)..(485): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatacttgtctctggtacaacagcaccaggcaaagcccccaaatcatgatttatgaggcagtaacgcgccctcagggtttctaatcgcttcctctggctccaagtctgcacacggcctcctgacatctctggctcgagctgaggacgagctgattattactgctgctcgattatcgctaggttaagtgtacctttgggtgtttcgggcgggtaagggccgagcgtacgaccgttccgaggttccncgccaaggctcggcccctcggttctaacc

SEQ ID NO: 315171 - DNA, 577 bp, Homo sapiens
  misc_feature: GZ8MTXP01AQML3.45.79.H02.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccaacngcaccaggacaaacgcccccaaatcatgatttatgaggnagtagcgcctgagggtttctaatcgcttcctctggctcaagtctgcaacaccggccctcccgtgacaactctcgtcggcctccgaggctaggacggacgagctgtattattactgcgtgctcgatagtgacgtaggttagtacgttacgtttgggtcgttcggggcggtaacgggttaccaaacggttccgtacgggtaccccgttcgttacgggttccgaaccggtcccgaacggtccgtcccggttacccccgtcgggttaacctccccg

SEQ ID NO: 315172 - DNA, 563 bp, Homo sapiens
  misc_feature: GZ8MTXP01D0ZC8.45.79.H02.1.454.CMB.2.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctgtacanagcaccagacaaacgccccaaactcatgtatttagngaggacagtaacgccggtaccctgtagggtttctaatcgtcttctctgcctcaagtctcgcaacaccggtccctaccctagacaatcctcgtcgggctccgaggctaggaggacgagtctagtattattactgtctgctatatatgacgtaggttaagtgttacgtttggtgttcgggaacggaggttaaccaagttcgtacggtccgttacgttcggacgtaacgacccgaaggtccgtcccgccccgttcggttaacctcccg

SEQ ID NO: 315173 - DNA, 527 bp, Homo sapiens
  misc_feature: GZ8MTXP01DCQN4.45.79.H02.1.454.CMB.2.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (504)..(504): a, c, t, g, unknown or other
  misc_feature (504)..(504): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaacagcaccaggacaaacgcccccaaatcatgatttangaggcagtaagcggcctgtagggtttcaatcgcttcctctgctcaagtctgcacacgcctcctagacatctcgtcggctcgaggctgaggcgagctgattatactgcgtgtctactatagtgacgtaggttagttagttcgtttggtcggtcgggcggacggacaagcgtcgtaccgttccgttggcgtaacgacccgaagtccnccgttcccctcggttctaacccg

SEQ ID NO: 315174 - DNA, 622 bp, Homo sapiens
  misc_feature: GZ8MTXP01EQ8FJ.45.79.H02.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgtcctgactcagcctgcctccgtgtctgggtctcctggacagtcgatcaccatctctgcactggaaccngcagtgatggtgggattatacttgtctctgtacacagcaccagacaaacgccccaatcatgtatttagngaggacagtaagccgcctcgtaggtttacaagtcgtcttccgtcgtgctacctaagtctacggcaaccgccggtccctacccgtagaactaactccgtcgtcgggcctccgaaggcgtaggacggacgtagtctagtacttacttacgtcgtcgtgtacctatattaagtcgacgttaaggttagttacgttacggtttgggtcggttcggggaacggtaacgggttaccgtagggttaccgtaccggttacgttacgggttcaccggaaccccggtaacgtcccgttcccggtcccccgttacggtcccgttaaccgtttccccgg

SEQ ID NO: 315175 - DNA, 552 bp, Homo sapiens
  misc_feature: GZ8MTXP01BRMCW.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccacagcaccaggcaaagcccccaaactcatgatttatgaggcagtaagcggccctcaggggtttctaatcgtcttctctggctccaagtctgcaacacggccctccctgacaagtctctgggctccaggctgaggacgaggctgacttagttactgctagtctcatatgcgtaggtagttagttacgtttggttagttcgggcgggtaagggaccgtaaagcgttacgaacccgttcgttacggttcgaacggacccgaaggtcctccggccccgtcgttaaccgtcccg

SEQ ID NO: 315176 - DNA, 655 bp, Homo sapiens
  misc_feature: GZ8MTXP01AWFXL.45.79.H02.1.454.CMB.2.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatacttgtctctgtacacagcaccagaccaaacgccccaaatcatgtatttagnggaggacaggtacggccggtccctagtacggggtttactaagtcgtcttcctcgtcggctaccgtaacgtcgtacgggccaaccgtaccgggtcccttacccgtacgaacctaacttcctcggttcggggccttaccggcgggtaccgttagggaacgggtacggacgggtcttaggtaactttacgttacgtcgtcgttcgtccgttacagttacgtggtacgtagggtttacgttaggtttaccggtttggggtcggttacggggaacgggtaacgggaccgtaacggttcgtacggtacccgttcgttacggttccgaacgaccgtaacggcctacccgccccgtggttccctccg

SEQ ID NO: 315177 - DNA, 553 bp, Homo sapiens
  misc_feature: GZ8MTXP01EYFMK.45.79.H02.1.454.CMB.2.raw
  modified_base (223)..(223): a, c, t, g, unknown or other
  misc_feature (223)..(223): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctctgcactggaaccngcagtgattggtggattataccttgtctctgtacaacagcaccagacaaacgcccccaaatcatgtatttatgaggacagtaacgccggtcctcgtaggggtttactaagtcgtcttccctcgttggcctcgaagtcgtggctaaaccgacggccctccccgtagaacctaattcgtccgtgggcttcccgaggcctaggaggacgaggtctagacttatactgctgctacatatgctaggtatagttacgtttggtgttcgggaacgtaggacctaagcgtgtacccgttacgttggacaacgccgaaggcctcgcccctgttcctccg

SEQ ID NO: 315178 - DNA, 547 bp, Homo sapiens
  misc_feature: GZ8MTXP01BJIB8.45.79.H02.1.454.CMB.2.raw
  modified_base (225)..(225): a, c, t, g, unknown or other
  misc_feature (225)..(225): n is a, c, g, or t
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgttgggattataaccttgtctcctggtaccaacagcacccaggcaaacgcccccaaatcaatgatttatgaggcagtaagcgcctgagggtttcaatcgcttctctggctaccaagtctgctaacacggcctccctgacatctcngggctccaggctgaggacgaggctgattagtactgctgcctnatatgcgtaggtagtgttagtttgggcgttcggaacgggtagggacctaaaggcgttacggaacccgttcgttcggttccaaggaccccgaaggtccctcggccccccgtcggtttccgtaaccccg

SEQ ID NO: 315179 - DNA, 562 bp, Homo sapiens
  misc_feature: GZ8MTXP01B286Q.45.79.H02.1.454.CMB.2.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (366)..(366): a, c, t, g, unknown or other
  misc_feature (366)..(366): n is a, c, g, or t
  modified_base (433)..(433): a, c, t, g, unknown or other
  misc_feature (433)..(433): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcatcaccatctctgcactggaaccngcagtgatgttgggattatacttgtctctgtacacagcaccagacaaacgaccccaaactcatgtatttangaggacagtaagcgcctgtagggtttactaatcgtcttcctctggctcaagtctcggcaacgacgccctccngacactctcgtggctaccgaggctggacggtacgaggctgtattatactgtctgtctcagtagtgtntaggttagttagtttacgttggttcggttcgggaacgggaacggaccgtaagttccgtacgtacccggttccgttaggccaaccggcccgtaacgtcccgtcccgttccccgtcggttaacccttcccg

SEQ ID NO: 315180 - DNA, 511 bp, Homo sapiens
  misc_feature: GZ8MTXP01DL0WO.45.79.H02.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (488)..(488): a, c, t, g, unknown or other
  misc_feature (488)..(488): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgttgggattanactgctctgtacanagcaccagcaaacgccccaaatcatgatttangaggcagtaagccggtcctgtagggtttcaatcgtcttcnctgctcagtctgcacncgcctcctgacatctctggctcagctgagacgagctgattatactgacgtgctcatatgcgtaggtagtgttacgtttggtggttcggaacgggaggacgtaagcgtcggtaccgttcgttcgttcgaagacccgaaggccncggttacccctggttcctaaccg

SEQ ID NO: 315181 - DNA, 672 bp, Homo sapiens
  misc_feature: GZ8MTXP01B8PD8.45.79.H02.1.454.CMB.2.raw
  modified_base (320)..(320): a, c, t, g, unknown or other
  misc_feature (320)..(320): n is a, c, g, or t
  modified_base (462)..(462): a, c, t, g, unknown or other
  misc_feature (462)..(462): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgtggacagtcgatcacatcctctgcacgtaggaaccagcagtgtagtggttagggatttactaacgttgtctcgtgtaccaacacgaccaccgaggaccaaaccgacccccaaactcatgactttagnggaacggacaacgtaacggccggtccctaggttacgggtttactaacgtcgttaccttccgtcgtggtacctccgaaagttcacgggtaaccaaaccgtaccgtccccttaccctagaactaactcgtacgtcgggtacccncgaggtcgtaggaaggtacgtagtactagtacttagtacgtcgtacgtcgtactatagtacgtagtacgttaggttacgttagttacggtttgggtacgggtacggggaacgggtaaccggacgtacggttacgtaccgtaccgttacgttcggaccgtaaccgacccggtaaccgtcccgtccggttccccgttaaccgttccgtcccg

SEQ ID NO: 315182 - DNA, 560 bp, Homo sapiens
  misc_feature: GZ8MTXP01CZY07.45.79.H02.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactgaaccngcagtgatgtgggattatacttntctctgtacaacngcaccagacaaacgccccaancatntatttagngagganagtagccggtccngtaggttctatcgtcttctcgtgctacagtctcggcaacgccgccctccagactatctcgtaggcctcgngtcgtaggaggacgagtctagtacttattacncggtctacgtctctagtagtcgtacggtaggttacgttagtttacgtttgggtagttcgggaacgggtacggacgtaagccgtacgtccgttaccgttggttccaacggcccgaacgtcccgtccggttccccttcgccgttcccg

SEQ ID NO: 315183 - DNA, 534 bp, Homo sapiens
  misc_feature: GZ8MTXP01CFKXW.45.79.H02.1.454.CMB.2.raw
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcacccaggcaaacgcccccaaactcatgatttatgaggacagtaagcggccctcgtaggggtttctaatcgcttcctctggctcaagtctggcaacacggcctccngacatctctggctcagctgaggacgagctgattatactgctgctcatatgctaggtagtgttacgttgggtgttcgggcgggagggttacaagcgtaggacccgttcgttacggttcaacggtcccaagggtccctcggcccccgtcggttcctaacccg

SEQ ID NO: 315184 - DNA, 499 bp, Homo sapiens
  misc_feature: GZ8MTXP01ADSYV.45.79.H02.1.454.CMB.2.raw
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacactcgatcaccatctcctgcactggaaccngcagtgatgtgggattatacctgtctctgtacaacagcaccaggcaaagccccaaactcatgatttatgaggcagtaagcggcctcagggtttctaatcgcttccnctggctccaagtcctggcacacggcctcctgacaatctctgggctccaggctgaggacgaggctgattatactgctgctcatatgnaggtatgtactttggtgttcggnggagggaccaagcgtgacccgttcgttagttcaacgccaagctcgcccctcggctcccg

SEQ ID NO: 315185 - DNA, 566 bp, Homo sapiens
  misc_feature: GZ8MTXP01BWV51.45.79.H02.1.454.CMB.2.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactggaaccagcagtgatggttgggattatactgtctctgtacacngcaccaggcaaacgccccaancatgatttangaggcagtagccgcctgtagggtttctaagtcgcttctctggctacagtcngcaacgacggtccctcctagacactctcgtggcctcgaggctggacggacgagtctagtattattacgtgcgtgtctnagttngtacgtaggtacgttagttacgtttgggtcggttgggcgggtaacggacctaacggttcgtacggtacccgttcgttacggttaccgaaccggacccgtaagggccgtacccgcccccgttcggttcccttaacccg

SEQ ID NO: 315186 - DNA, 518 bp, Homo sapiens
  misc_feature: GZ8MTXP01EHSUL.45.79.H02.1.454.CMB.2.raw
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (502)..(502): a, c, t, g, unknown or other
  misc_feature (502)..(502): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcacccagacaaacgcccccaaatcatgatttatgaggcagtaagccggcctnagggtttctaatcgcttccnctgctcaagtctgcaacacggccctcctgacatctctggctcgagctgacggacgaggctagattattactgctgcctnatntcgcaggtagttgtacgtttggtggttcggcggtaggacaagttcgtgaccgttcgagttcaacgcccgaagccgtaccnccccgtgttcctcccg

SEQ ID NO: 315187 - DNA, 565 bp, Homo sapiens
  misc_feature: GZ8MTXP01CQ4G3.45.79.H02.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
  modified_base (485)..(485): a, c, t, g, unknown or other
  misc_feature (485)..(485): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataacttgtctctggtacaacagcaccagaaccaaacgacccccaaatcatgtatttanggaggcagtacgccggtcctcgtagggtttctaactcgtcttcctcgtggctccaagtctcggcaacgaccgtcctccagactatctacgtggctccgnggctaggaggacgngctagtattatacgtgtcgtgcttacagtatcgacgtagtaggttgttacgttgggtcggttcgggngggtacggacgacggcgtacgtacccgttgttacggcctaacgaccgtaacgggtcctcccggccccgtcggttctcccg

SEQ ID NO: 315188 - DNA, 538 bp, Homo sapiens
  misc_feature: GZ8MTXP01CNU2N.45.79.H02.1.454.CMB.2.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtnatgtggattanacttgtctctgtacanagcaccagcaaacgccccaaatcatgtatttagngtagggacaggtaacgccggtccctcgtaggggtttactaagtcgtcttcctctgctcaagtctcggcaacaccggcctcccgtgactaatcctcgtcgggactcgagctgagacgngctgattaatntgctcgtctnatgngtcgtaggttataggttacgtttggtacggtcgggtaacggaggacctaagccgtgtaaccgcgttagccgaacgccgaaggtctccgccctggaaccgtcccg

SEQ ID NO: 315189 - DNA, 575 bp, Homo sapiens
  misc_feature: GZ8MTXP01BVZN3.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattatacttgtctctgtacaacngcaccagcaaacgccccaaatcatgatttangaggcagtagcgcctgtagggttctaatcgtcttctctggctaccaagtctgcaacaccggccctccctagaccaatctcgtggcctccgaggctggaggacgaggtctagattatactgctgtcctanatatgacgtaggttagtagttacgtttggtcggttcgggaacgggtaacgggacctaaaggttccgtacggtacccggttaccgttaacgggttcctaaccgggtaccccgaacggtcccgtccggttcccccgttaacgggttccctccccg

SEQ ID NO: 315190 - DNA, 551 bp, Homo sapiens
  misc_feature: GZ8MTXP01BG3R3.45.79.H02.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (412)..(412): a, c, t, g, unknown or other
  misc_feature (412)..(412): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataccttgtctctggtacacagcaccagcaaagcccccaaatcatgatttangaggcagtaagcgcctgagggtttcaatcgcttcctctggctcaagtctggcaacacggcctcctagacaatctctggctcaggctggaggacgaggctgtatattatgctgcctanagtatgctagggttaagtagttacgtttggtaggtttcgggcgggtagggttacccaaaggttcgttcggacccgttaccgttgggttaccaacgaccccgaaggtccgtcccgcccccgttcgggttaaccgtccccg

SEQ ID NO: 315191 - DNA, 560 bp, Homo sapiens
  misc_feature: GZ8MTXP01BH791.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattgttgggattatacttgtctctggtacaangcaccaggcaaacgcccccaaactcatgatttatgaggcagtaagcgcctcgagggtttctaatcgtcttcctctggctccaagtctggcaacaccggcctcctgacaatctctgggctcgagcgtggaaggacgaggctgtattattactgctgtctcatatgcgtaggttaagttagttacgtttgggttacgttcgggcggtaacgggacctaaacggcgtacggtacccgttccgttacggttaccgaacggcccgaacggtcccgtccgcccccgtggttcccttaacccg

SEQ ID NO: 315192 - DNA, 614 bp, Homo sapiens
  misc_feature: GZ8MTXP01A9II2.45.79.H02.1.454.CMB.2.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (475)..(475): a, c, t, g, unknown or other
  misc_feature (475)..(475): n is a, c, g, or t
  modified_base (587)..(587): a, c, t, g, unknown or other
  misc_feature (587)..(587): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataccttgtctctgtacacagcaccagacaaacgccccaaatcatgatttangaggcagtagccggcctgtagggtttctaatcgtacttcctcgtcggctaccgaagtctcggccaaacgacccgggtccctaccccgtaggaacctaacgttccgtcgtcgggaccttccgagggtcctagggaacggacggaggtctagtatttactacgtgcgtgtctactagtagngtacgtaggttagttaacggttcgtttgggtcggttcgggaacgggaacggttacaacggttcgtacgggtacccttccggttaggttaccgaacgacccggtaaggtcccnccggttcccctcgggttccgtaacccg

SEQ ID NO: 315193 - DNA, 534 bp, Homo sapiens
  misc_feature: GZ8MTXP01DOQGQ.45.79.H02.1.454.CMB.2.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
  modified_base (455)..(455): a, c, t, g, unknown or other
  misc_feature (455)..(455): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccatcctcctgcactggaaccngcagtgatgtggattatacttntctctgtacaanagcaccaggcaaacgcccccaaatcatgatttangaggcagtaagcgcctgagggtttctaatcgcttctctggctccaagtctgcaacacggccctccngacaatcactggctccaggctgaggcgaggctgtattattactcgcgtagtctacattatgcgtaggttagttagttacgtttggttggtcgggnggagggacctaacggcgtacggtaccgttcgttggttcaacgcccgaacggtccaccgttccccgtcggttaacctccg

SEQ ID NO: 315194 - DNA, 600 bp, Homo sapiens
  misc_feature: GZ8MTXP01B00H1.45.79.H02.1.454.CMB.2.raw
  modified_base (456)..(456): a, c, t, g, unknown or other
  misc_feature (456)..(456): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccactcccctgcactggactccgagcggtgtacgtttattgtttttaagattcgtctctggtatcagcaacacccagacaaacgaccccaactcatctatttatgatgtacaatagtccgccttcgtagggtttctctactcgtccttctcgtcgtcctacgtaaagtcgtggactaacgtccggccctcccgtacgacctactcctcgtcgggctcgagcgtagaagacgacggctagtacttattacngggcagtcaactattatagtttacgttcgtttccgtacgttcgggtacgttcgggaacgggtacggacgtaggttcgtaccgtcgttacggttccacggcccgacggtcccgtacccgtccccgttcgtccttaacgttccccg

SEQ ID NO: 315195 - DNA, 534 bp, Homo sapiens
  misc_feature: GZ8MTXP01DH288.45.79.H02.1.454.CMB.2.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtcgtggtctcctggacagtcatcacatctctgcactggaaccngcagtgatggttaggattatactntctctgtacangcaccagacaaacgcccaaancatntatangaggnagagcgcctgtaggttcatcgtcttctctgtctacgagtcngcaacgcgtccctccgtagacaactctcgtcggtctcgacgtcgtaggaacggagagtcgtagtattaactctcgctgtcttanatgtgtagtaggttagttcgttgttggtcggtcggaacggtaacggacgtacgttcgtacgtaccgttcgttcgaccgaacgaccgtaacgccgtcccgttcccgtcgttccgtccg

SEQ ID NO: 315196 - DNA, 542 bp, Homo sapiens
  misc_feature: GZ8MTXP01EBMKF.45.79.H02.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtggattataacttgtctctggtaccaacagcaccaggcaaacgcccccaaatcatgatttangaggcagtaagcgcctgaggtttctaatcgtcttccnctgctcagtctggcacncgcctcctgacatctactggctcgagctagaggacgagctgattntatgctagctcatangcgtaggtagttgtacgtttgggtgttcggggcggtaacgggacctaaggttcgtacggtaccccgttcgttagggttccaacggaccccgaaggtcccgtccgttcccccgttccgggttcttaaccccg

SEQ ID NO: 315197 - DNA, 615 bp, Homo sapiens
  misc_feature: GZ8MTXP01EC4PF.45.79.H02.1.454.CMB.2.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctcctgcactggaaccngcagtgatggttaggattataacttgtctctgtacangcaccagacaaacgccccaaatcatgatttagagaggacagtacgccggtcctgtagggtttctatcgtcttctctggctcagtctggcacgaccggtccctacccgtgactattcgtcgtcgtctccgagcgtaggacggacgagtcgtagtattattacgtgtctcgtcttacaagttcgtgacgttaggttaacggttacgtttacgggttttggtacggttcgggaacgggtaacgggttacctaaacggttcgttaccggaacccggtttaccgttcgggttacccgaacggtaccccgtaacgggtccctcccggttacccccggttaacggttcccttccccgg

SEQ ID NO: 315198 - DNA, 548 bp, Homo sapiens
  misc_feature: GZ8MTXP01DGYC2.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcatcaccatctcctgcactggaaccngcagtgatgttgggattatacttgtctctggtacaanagcaccaggacaaacgccccaaatcatntatttangaggcagtaagcgccctgtacgggtttctaagtcgtcttcctctggctcaagtctggcaacncggtcctcctgactacnctcgtggcctcgagctaggaggacgaggtactaggtacttaagttactgtccgtgtacctntaatagngtacgtaggttagtagtttacgttgggtcgttcgggaacggacggacgtaacgcgtacgccgttcgttgcgcgaccgtaacgcctacgcccctgttaacctccg

SEQ ID NO: 315199 - DNA, 529 bp, Homo sapiens
  misc_feature: GZ8MTXP01C9M82.45.79.H02.1.454.CMB.2.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatgttgggattatacttgtctctgtacangcaccagcaaacgccccaaancatgatttangaggnagtaagcgtcctgtagggtttctaatcgtcttcctctggctccaagtctggcaacncggcctcctgacatctcgtgggctccgaggcctggaacggcgaggctgacttattactgctgctcatagtgcgtaggttaagtgttacgtttgggtcgttcgggaacggagggacaaggcgtacggtaccgttcgttaggttcaacgcccaaggcctcgcccctggttcctcccg

SEQ ID NO: 315200 - DNA, 682 bp, Homo sapiens
  misc_feature: GZ8MTXP01AKFBT.45.79.H02.1.454.CMB.2.raw
  modified_base (228)..(228): a, c, t, g, unknown or other
  misc_feature (228)..(228): n is a, c, g, or t
  modified_base (482)..(482): a, c, t, g, unknown or other
  misc_feature (482)..(482): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaangtgattggttgggtagtttttagtttgtcttcctaggtaaccaacaacaccccggacgaacgaccccccaaaataatcctaatttaacgtagggaacacgtaaagccggccctcgtaggggtttctaagtcgtcttctctggctccaagtcctaggacaacgaccggtccctaccctagaactaaactccgtcgtcggggtcctccgagggcctaggaggacgagggctagtaatttatactgctgctcatacnggctagggttatagttacgtttgggtcggtttacgggacggggaacggtcccgtaaaggtcctacggtaacccggtacccgttaggggtcccaggttaacccccgaagggttcccgttacccggttccccccccgttggggtacccctaaccggtttcccttacccggtttccccctaacccccgtttccttaaccccgg

SEQ ID NO: 315201 - DNA, 555 bp, Homo sapiens
  misc_feature: GZ8MTXP01AE15O.45.79.H02.1.454.CMB.2.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (262)..(263): a, c, t, g, unknown or other
  misc_feature (262)..(263): n is a, c, g, or t
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcacntctcctgcactggaaccngcagtgattggtgggattataccttgtctctgtaccacnncaccagacaaacgccccaaatcatgatttagngaggcagtagcgccctgtaggttcagtcgtcttcctctggctcagtctgcacncgcctcctgacatcncgtggctcgnggcctggacggagagtctagtacttagttctggctgctacatagtcgcgtagggttagttaacggtttcgtttgggtcggttccggggaaggaacgggttacctaacggcgtacggtacccgttacgttcggccaaccggtaccgaacgggtcccttccggccccgttaaggttcctccccg

SEQ ID NO: 315202 - DNA, 734 bp, Homo sapiens
  misc_feature: GZ8MTXP01EA2VH.45.79.H02.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactggaaccngcagtgatgtgggattatacttgtctctgtacangcaccagcaaacgccccaaatcatgtatttagtgaggcaggtaagccggtccctacgtaggggtttactaagtcgtctttaccctcgtcggtcctacccgtaagttccgtacggaacccgaaaccgtacccgggtccccttaccccgtacgaacctaaacgttcccgtccgtcgggggtacccttacccggaagggtccgttagggaaaccggggtaccggtagggtaccttacggttaaatttaacgttaaccgtcggttacgttcgtaccgttacctaagttagtacgaccgttaagggttaacgtttaggtttaaccggttttggggttcgggtttccgggggtaacggggaacgggttacccgtaaagttcccgttacggtaccccggtttacggttcgggttaccgtaaccgggaccccgtaacgggtccccgtacccggcccccgtttcccgggttccttaaccccg

SEQ ID NO: 315203 - DNA, 614 bp, Homo sapiens
  misc_feature: GZ8MTXP01AQORH.45.79.H02.1.454.CMB.2.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatgtggattatactgtctctgtacacngcaccagacaaacgccccaaatcatgatttangaggcagtaacgcgcctgtagggttctaatcgtcttctctggctcagtctggcaacgccggcctccctgacaatcctcgtgggcctacccgagggtcctaggacgggacgtaggcttagtatttattaccgtgacgagactactaattaacttagtttacgttcgtttacccacggttacggggttacgttaccggggcgggaacggggtaaccttaaagggtttccggaaccccgttacggttaacgggttccgaccggaccccgtaacgggtccctccggtccccccgttacgggttccctaacccgttccgtttcccccgg

SEQ ID NO: 315204 - DNA, 633 bp, Homo sapiens
  misc_feature: GZ8MTXP01ASWM9.45.79.H02.1.454.CMB.2.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcgatcaccntcctctgcacgtggaaccagcagtgattggttagggattataaccttgtctcctggtacaacagcaccaggacaaacgccccaaatcatgtatttaaangaggcagtacgcgcctgtagggtttctaatcgtcttcctctggtctaccgaagttcgtcggccaacgcccggtaccctcccctagactaactcctcgtacgggcctcgaggtcgtaggaggaccgtagggtctaggtaacttagttacgtcgtacgtcgtacttacagtatcgacgtaaggttacgttagttaccgtttgggtcgtttcggggcgggtaacgggttaccgaaacggttcgtaacggtacccggttaccgttacggttccgaaccggtcccgtaacggtccgtcccggttacccccgttcgggttccttaaccccg

SEQ ID NO: 315205 - DNA, 572 bp, Homo sapiens
  misc_feature: GZ8MTXP01AM36I.45.79.H02.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (564)..(564): a, c, t, g, unknown or other
  misc_feature (564)..(564): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccngcagtgatgtgggattatacttgtctcgtgtacacngcaccaggacaaacgaccccaaactcatgatttagngaggcagtagccgcctcgtagggtttctaagtcgcttcctctgctcaagtcngcacncggcctcctgacactctcgtacggctcgagtcgtaggacggacggacgtcttacgtactttaacgttacgtggtcctcggtacttacctagttacgtacgtacgtaagggttagttaacgttggtttacggtcggttcgggaacgggtacgggttacgtaggttcgaccgttcgttggttcacgtccgagcctacgccccgttgtaaccncgttcccg

SEQ ID NO: 315206 - DNA, 598 bp, Homo sapiens
  misc_feature: GZ8MTXP01BAG40.45.79.H02.1.454.CMB.2.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacngtcgatcaccatcnctgcactggaaccngcagtgatgttgggattatacttgtctctgtacacancaccagacaaacgccccaatcatnattangaggnagtagcgcctgaggtttcatcgtcttcctctgctcaagtctggcacacggtccctcccgtagacaactcgtcngggtcctacgnggccttaggaacgggacgtggctagtacttacttacgtcgtctcgtacgttacagtttacgngtcggttaagggttacgttagtttaacggtttcgggttaacgggtccgggtaacggggtaacggttaccgaaagttccgtacgtaccggttaccgttcggttaccaaccggacccgtaacggtcccgtcccgttaccccgtcccggttaacgtccccg

SEQ ID NO: 315207 - DNA, 541 bp, Homo sapiens
  misc_feature: GZ8MTXP01BCE0D.45.79.H02.1.454.CMB.2.raw
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (499)..(499): a, c, t, g, unknown or other
  misc_feature (499)..(499): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctctgcactggaaccagcagtgatgtggtattatacttgtctctgtacangcaccagacaaacgccccaaancatgtatttagngagganagtacgccgcctgtaggtttcatcgcttctctgctacagtctcgcaacncggcctccngacatctcgtcggctacgngntaggagacgngtctagtattaattcgtgtcgtgtactcgtaatagtgacgtaggttacggttattacggtttgggtcgttggggaacgggaacggttacgagttccgtacggtcgttacgngttccgaagtcccgaaggtccctccgcccgtcggttctcccg

SEQ ID NO: 315208 - DNA, 591 bp, Homo sapiens
  misc_feature: GZ8MTXP01CW3QQ.45.79.H02.1.454.CMB.2.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctcgtgtcgtggtctctggacagtcatcacatcnctgcatggaacngcagtgatggtaggattactactgtctcgtagaaccanacgcaccgagaccaaacnccccaatcatagtattagaggaggacagtacgcgtaccgtacggtaggttacaacgtcgtcttccgtcgtgtacctacgaacgttcgacgaaccaaacgtcccgtcctaccgtagaactagtcctcgtcggcctacgngtcgaggacggacgagtcgtattattaactgtcgtgtcgtactagtagtagtgtacgttaaggttacgttacggttcggttgggtacggtcgggaacggtaacggacgtacgttcgtaacgtaccgttacgttcgacgaaccgaccgtaacgtcccgcccgttcctcgttccgtccg

SEQ ID NO: 315209 - DNA, 543 bp, Homo sapiens
  misc_feature: GZ8MTXP01ACIC7.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtacanagcaccagcaaacgccccaaatcatgatttangaggcagtacgcgcctcgtagggtttctaatcgcttcctctgctcaagtctgggcaacacggtcctccctgacaatctcgtgggcctccgaggtctgaggacgagctgattactactgctgtctcatgtgcgtaggttatagttacgtttgggtcggttcgggaacgggaggaccgtaagcgtacgtacccgttcgttagggttccaacggccctaaggtcctccggttcccccttggttcctaacccg

SEQ ID NO: 315210 - DNA, 610 bp, Homo sapiens
  misc_feature: GZ8MTXP01E0IU8.45.79.H02.1.454.CMB.2.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggtattttagtttgtctctggtaccaacaacaccccggcgaacgcccccaaactaatcatttagtaggacactaagcggcccgtcgggggtttcaagtcgcttctctggctcaagtcctggcaacgaccgccctccctgaacaatctcgtgggcctccgaggctcaggacgaggctgtatttatttctgttgctcatatgcgtaggttagtagttacgtttggtggtttcggcggggtaacgggaccgtaagtccgtacggtacccggtccgtaagggttccacggaccccgtaaacggtccttcccggccccccgttacgggtccaccgttcccgttccgttcccccaccccttcccttccgttaaccgg

SEQ ID NO: 315211 - DNA, 585 bp, Homo sapiens
  misc_feature: GZ8MTXP01DBDGK.45.79.H02.1.454.CMB.2.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccntcctcctgcactggaaccngcagtgatggttaggattatactgtctctgtacanagcaccaggcaaacgccccaaatcatnattangagcagtacgcgcctgtagggttactatcgtcttcctctggctaccagtctgccaacnccggtccctcctgactactctactggcttccgaggcctaggaaggacgtaggacgtgtattacttacgtcggcttaacggtctactaatgtacgtcgtaaggttagttacggtttacggtttgggcgggtttccgggaagggtacgggaccgtaaaggcctagggtacccgttacgttacggccgaacggtacccgtaacggcctcccggttaccccgtcgaacccgttcccg

SEQ ID NO: 315212 - DNA, 599 bp, Homo sapiens
  misc_feature: GZ8MTXP01B9MK3.45.79.H02.1.454.CMB.2.raw
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggtgggattatacttgtctctgtaccaangccaccagacaaacgccccaaatcatgattangaggnagtagcgcctcgtagggttctaactcgtcttcctctgctcaagtctcgcacgaccgccctcctgactatctcgtgggcctcgaggctaggaggacgaggtctagtattacttacgtcgtcgttcgactcgtaatagtcgtacgtaggttaagttaggtttaccggtttgggttcggttccggggaacgggtaacgggaaccgtaacgttccgttacgggtacccgttaccgttacgggttccgaaccggccccgtaacggtccccgttccgttcccccgtcgggttcccgttaacccg

SEQ ID NO: 315213 - DNA, 582 bp, Homo sapiens
  misc_feature: GZ8MTXP01E0VKY.45.79.H02.1.454.CMB.2.raw
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgatgttgggattataacttgtctctgtacaacagcaccaggacaaacgcccccaaatcatgtatttangaggacagtaagccgcctcgtagggtttctaatcgcttcctctggctccaagtctcggcaacgaccggccctcctgaacactctcgtgggcctccgaggcctggacggacgaggtctagtacttattactgacgtgtctctatgtgcgtaggttagttagttacgtttgggtcgggttcggggaacgggacgggaacctaaggttccgtacggtccccgttacgttcgggttccaacggccccgaagggtccctccggcccccgttaacggttccctaacccg

SEQ ID NO: 315214 - DNA, 520 bp, Homo sapiens
  misc_feature: GZ8MTXP01DCY4T.45.79.H02.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (427)..(427): a, c, t, g, unknown or other
  misc_feature (427)..(427): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtacaacagcaccaggcaaacgcccccaaatcatgatttangaggcagtaagtggccctnaggggtttctaatcgcttcctctggctccaagtctggcaacaccggcctccctgacaatctctggctccgaggctgaggacgaggctgattattactgctgctcatatgnaggtatgttactttggtgttcggcggtagggaccaggcgtggccgttcgttggttccaagccccgaaggcctacgccccgtcggttctaaccg

SEQ ID NO: 315215 - DNA, 758 bp, Homo sapiens
  misc_feature: GZ8MTXP01DU7RX.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcacgtggaaccngcagtgagtggttagggattactacttgtctctaggtaccaacagccaccagacaaacgacccccaaatcatgtatttagtgaggcagtaacggccggtccctagtagggtttactaagtcgtctttccgtctggtcctacctaacggtccttacggccctaaaccgtacccgggtccccttaccccgtaggaacctaaacgttcccgttccgtacgggtccctacccggtacgggaccgttagggaaacggggtaccggtaacgggtccgttaaggttaaactttacgttaacccgtgggtccttacggtaccttacctaaacgttagtacgggtaaccggttaaggggtttaaacgttttaccggtttaaggttttcggggttcgggttaccgggggtaacggggtaaacggggttaaccgtaaaccggttcgttaccgggtacccggttaccggttcggttaccggaaccggtacccgtaacggttcccggtccccggttcccgttcccgggttcctttaaccccggg

SEQ ID NO: 315216 - DNA, 593 bp, Homo sapiens
  misc_feature: GZ8MTXP01BQW68.45.79.H02.1.454.CMB.2.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacntctcctgcatgaaccngcagtgatgtggattatacttgtctctgtacacagcaccagacaaacgccccaaatcatntattangaggacagtacgccgtcctcgtagggtttactaagtcgtcttcctcgtgctctaagtcgtacgcgaaccaccggccctcccgtagactatcctacgtcgggcctacgaggcgtaggaacggacgtacgtcgtagtaatttacgtacttcgtcttcgtctacagttagtcgtacgtaaggttagttacgttacggtttgggttacggttcgggaacgggtacggaccgtaagttccgtacgacccggttccgaggttaccgaacgacccgaacgtccgtacccgttccccgtcggttctaacccg

SEQ ID NO: 315217 - DNA, 635 bp, Homo sapiens
  misc_feature: GZ8MTXP01DJKGU.45.79.H02.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccatctcctgcactggaaccngcagtgatgttagggattataaccttgtctctggtaccaacagcaccagcaaacgcccccaatcatgtattangaggnagtagcgcctcgtagggtttctaacgtcgtctttcctcgtggcctccgaagtccgtaggccaaacgtacccgggcccttacccctacgactaaacgttccgttaccgtcggggtccttaccgagggtacccgttagggaacgggacggtaaggtcctaggtaatttacgttaacgtcgtcgttcgtaccttataacgtagtgtacgtaaggttaacgttagttacgtttgggtacgttcggggaacggtacggacaacggttcgtacggtaccgttacgttcggttacgtaacggacccgaaggtccctccgccccttggttaacccttccg

SEQ ID NO: 315218 - DNA, 559 bp, Homo sapiens
  misc_feature: GZ8MTXP01CTD16.45.79.H02.1.454.CMB.2.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatcctctgcactggaaccngcagtgatggttaggattatacttgtctctgtacacagcaccagcaaacgcccccaaatcatgattangaggnagtagcgcctagnggttnatcgcttcnctggctacgacgtctcggcacgaccggcctccngtacatcctcgtggcctcgaggctaggacggacgaggtctaggtattacgttacgtgtccttgactttaanagtagtgtagtaggttaggttagttcggtttgggtcggtcgggaacgggaacggacgtacgcgtaccggtaccgttccgttacgccgaacgtacccgtaacggcctcccggttccccgtcgttccgtccg

SEQ ID NO: 315219 - DNA, 600 bp, Homo sapiens
  misc_feature: GZ8MTXP01DO1A0.45.79.H02.1.454.CMB.2.raw
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattatactgtctctgtacanagcaccagacaaacgccccaaatcatgtattagnggaggcagtaacgcggtaccctagtagggtttctaatcgtacttcctctggcctaccgaagtccgtggccaaacgtacccgggtccctaccctagaactaacgtcctcgtcgggcctaccgaggtccgtaggaacggaccgaagggtcctagtattattacgtcggacttgacttacagtacgtgacgtaggttaagttagttacgtttgggtcggttcgggaacggtaggaccgtaagcgtaccggtaccgttcgttcggttacgaaccgcgaacggtccgtccgccccgtggttcctaacccg

SEQ ID NO: 315220 - DNA, 551 bp, Homo sapiens
  misc_feature: GZ8MTXP01AQAPS.45.79.H02.1.454.CMB.2.raw
  modified_base (262)..(263): a, c, t, g, unknown or other
  misc_feature (262)..(263): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (376)..(376): a, c, t, g, unknown or other
  misc_feature (376)..(376): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactggaaccagcagtgattgttgggattatacttgtctctgtacacnncaccagcaaacgccccaatcatnatttangagganagtagcgcctgtaggttcatcgtcttcctntgctcaagtctggcacgaccgtcctcctagactatctcgtggctacgngcgtagacggcgagctgtattattactgtcctagtctacagttctgtacgtaggttagttagttacgtttggggtacggttcggggaacgggaagggttaccgaggttccgtacggtacccgttcgttacggttcgaacgccgaagtcccgtaccgccccgtgttccgtaacccg

SEQ ID NO: 315221 - DNA, 735 bp, Homo sapiens
  misc_feature: GZ8MTXP01C4V2R.45.79.H02.1.454.CMB.2.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatctcctgcacgtggaaccngcagtgatggttagggattactacttgtctcgtagtaccacagcaccaggacaaacgaccccaaatcatntatttanggaggcagtaacgccgtcctacgtagggtttctaacgtcgtctttcctacgtcggtcctaccgtaacgtccgtacggcctaaaccgacccgggtcccttacccgacgtaacctaacgtcctcgtacgggtccttaccggagggccgttacggaacgggacggtaggtaccgttaggtaatttacgtttaaccgtggtccttaggtaccttactaagtttacgtccggaacggttagggtttaaagtttacggttttaaccggttttgggggttaccgttttacgggggaaccgggggtaacgggttaaacccgtaacggttccggttaaaccgggtcccgtttacccgggttagggttaccccgaacggttaccccgaacgggttccccgtccccggttacccccggttcggttcccgtttaaccccgg

SEQ ID NO: 315222 - DNA, 539 bp, Homo sapiens
  misc_feature: GZ8MTXP01CUT4Z.45.79.H02.1.454.CMB.2.raw
  modified_base (293)..(293): a, c, t, g, unknown or other
  misc_feature (293)..(293): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccagcagtgatgttgggattataacttgtctctgtacacagcaccagcaaacgccccaaatcatgatttangaggacagtacgcggccctagtagggtttctaatcgtcttcctctggctacaagtctggcaaacacggccctccagacaactctctcggctcgaggctgagtcgagctagattatactgctcgctcatactgcaggttagtagttacgtttggngttcgggnggtaacggaccaaagttcgtacggaccgttcgttggttaccgaacgacccgaaggtccgccgttccccgtcggttccgtaaccg

SEQ ID NO: 315223 - DNA, 596 bp, Homo sapiens
  misc_feature: GZ8MTXP01DE8AZ.45.79.H02.1.454.CMB.2.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttaggattatacttgtctctgtacacancaccagacaaacgccccaaatcatgtatttagngaggacagtacgccggtccgtcgggggttacaagtcgcttctcgtcggtctcgtaagtcgtacggaccaacgacgtccctaccctagaacctagtctcgtcggctccgagtcctgaaggacgaggtctaggtatttactttcgtgttcgacttacgtattagacggacgtacgggactaggtacgtacggttggggtcgtcggggcgggtaacgggacgttgggttccgacccgttacggtacggttcgcgacccgaaggtcctccggtccccgtggttcctaacgttcccgttcccg

SEQ ID NO: 315224 - DNA, 574 bp, Homo sapiens
  misc_feature: GZ8MTXP01D9PZH.45.79.H02.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtgggattatacttntctctagtaccacagcaccaggcaaacgccccaaactcatgtatttagtgagggacaggtaacgccggccctagtaggggtttctaagtcgtctttcctcgtggctcctaagtctgcacnccggccctcctgacatctcgnggctcgaggctgaacggacgagtctagtattattacgtgtctgtctactatagtcgagttaggtaagttcgttagtttgggtggtttcgggaacgggtaacgggacaaggttcgtaggtcccgttcggttacggttcgaaccgtaccgaaggtccctccggttccccgtcggttccctaacccg

SEQ ID NO: 315225 - DNA, 669 bp, Homo sapiens
  misc_feature: GZ8MTXP01DPXNP.45.79.H02.1.454.CMB.2.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatcctcctgcactggaaccngcagtgatgttggattatacttgtctctgtacaanagcaccagacaaacgacccccaaatcatgtatttagngagganagtacgcgtaccctcgtagggtttctaatcgtcttccctcgtcgcctacgaacgtcgtacggaaccaaccgaccgggtcccttaccccgtacgaactaaacgttcccgttacggtcggggtaccctccggaacgggtccgtacgggaaacgggaccggtaggtacgtacgttaatttacgttacgtcggtactcggttacctagtattagtcgtacgtaaggttacgttaagtttcgggttggttacgggttccggggaacgggtaacggaaccgtaacggttcgtaccggtaaccggttccgttacggacccaacgggaccccgtaacgtccgtccccgaccccgttcggttcccttaacccg

SEQ ID NO: 315226 - DNA, 555 bp, Homo sapiens
  misc_feature: GZ8MTXP01D2WT5.45.79.H02.1.454.CMB.2.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctgtacangcaccagcaaacgccccaaatcatgatttangaggcagtaagcggcctcgtagggtttctaagtcgtcttctctggtctccaagtcctgcaacgaccgccctcctagactatctacgtggctcgaggtctagacggacgagctagattattacgtntcgtgctcatatgacgtaggttaacgtgttacgtttgggtacgttcgggaaggtacgggacaaggttcgtacggtccgttaccgttggttccgaacgacccgtaaggtcccgtccgaccccgttcggttctaacccg

SEQ ID NO: 315227 - DNA, 529 bp, Homo sapiens
  misc_feature: GZ8MTXP01EIF2S.45.79.H02.1.454.CMB.2.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctgtacaanagcaccagcaaacgcccccaaatcatgatttangaggcagtaagcggcctgtagggtttctaagtcgtcttcctctgctccaagtctggcaacacggcctcctgacaagtctcgtggctcgaggctggaggacgaggctagtattattacngtctgccttnaattntgagtaggttagttagttgttggtggtcgggaaggagacgagttcgtacgtaccgttcgttggcaacgaccgtaaggtcctccgttcccgtcgttcctc

SEQ ID NO: 315228 - DNA, 724 bp, Homo sapiens
  misc_feature: GZ8MTXP01ELVOO.45.79.H02.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccatctcctgcactggaaccngcagtgattggtgggtaattactaacttgtctctggtacaacagcacagacaaacgccccaaatcatatattagtgaggatacggtaaggccgtcctggtacgggtttctaacgtcgtcttccctacgtcggtactaccaacgtcctagggccaaaccgtaccgggcccctacccgtacgaacctaaacgtttcgttaccgtcggggtccttacccggaacggtcgttacggggaaacgggtaaccgggtaggggtcccttaggttaaacctttaaggttaacccttggtaacccgggtttctacgttactacgttacgtaggtacggttaaggttaacggtttacggtttcgggtttacggggttaccgggttacggggaacggggtaaacggttaaccgtaacggttccggttaaccggtacccggttcggttacggttaccgaacccggaccgtaaccggtcccggtcccggttccccggttccgttcccgtccg

SEQ ID NO: 315229 - DNA, 539 bp, Homo sapiens
  misc_feature: GZ8MTXP01DTBV0.45.79.H02.1.454.CMB.2.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (430)..(430): a, c, t, g, unknown or other
  misc_feature (430)..(430): n is a, c, g, or t
  modified_base (517)..(517): a, c, t, g, unknown or other
  misc_feature (517)..(517): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattanactgtctctgtacaacngcaccaggacaaacgaccccaatcatagtattatggaggcagtaagccgcctgtagggttctaatcgtcttcctctgcctacaagtctgcaacacgcctcctgactatctcgtggctcgagtcgtagaggacgagtcgtagtattacttactgtctagtctacatatcgngtaggtagttagttacgttggtcgttcgggaacggaaggaccagttcgtacgtccgttacgttggaccaacgaccccgaaggtcccnccgttcccctcggccttaaccg

SEQ ID NO: 315230 - DNA, 722 bp, Homo sapiens
  misc_feature: GZ8MTXP01D3C62.45.79.H02.1.454.CMB.2.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (321)..(321): a, c, t, g, unknown or other
  misc_feature (321)..(321): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgagggtcctgggcccagtctgccctgactcagcctgcctccgtgtcgtggtctccgtggacagtcgatcaccatctcctgcacgtgaaccngcagtgtattggttagggtattactacttgtctcgtagtaccaanacgaccaccgacgacaaaccgaccccaaatcaactagtactttagnggaacgggactaacggtaacggcccggtaccgttacggtacgggtttacctaagtccgtaccttcccgtcgtacggtacctaccgtaaggtcctacgaacaaccgacccgggtccctaccgtagaactacgttctcggtacgggcctaccggagtccggtaggaaacgggtacgtaaccggggttacttagttaacgtttaacgttacgtacggtacggttacgttaccgttacgtaagtaaccggtacggacggtaacggtaccgtaggttaccgggtttacgggttcggggtccgggtaacgggtaacggggttaccggttacgggttacggtaccgtaccggttacggttaccgacgcggaccgtcgtcccgtccggttacccctcggttccctaacg

SEQ ID NO: 315231 - DNA, 608 bp, Homo sapiens
  misc_feature: GZ8MTXP01BP8B9.45.79.H02.1.454.CMB.2.raw
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngcagtgatggttagggattataccttgtctctgtacacngcaccagcaaacgaccccaacncatgtattatgaggcaggtagccgcctcgtagggtttctaagtcgtcttcctctcgctacgagtcgtcgccacgaccggtccctacctagactactctcgtcggctccgaggtcgtaggacggacgaggtctagtaattacttacgtgtcgtgtccttactaacttgtgcgttaaggttagtttacgttaccggtttagggtcggtttcgggaacggggtaacggttaacgtacgttcgtacggtaacccgttacggttcggttaccgaaccggacccgtaacggtccgtcccggccccgttaacgttcccgttccccg

SEQ ID NO: 315232 - DNA, 542 bp, Homo sapiens
  misc_feature: GZ8MTXP01EZJC1.45.79.H02.1.454.CMB.2.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctctggacagtcgancaccatctcctgcactggaaccagcagtgatgttggattatactgtctctgtacaacngcaccagcaaagccccaaatcatgatttangaggcagtacgcgtcctcgagggtttcaatcgtcttcctctggctccaagtctggcaaacnccgcctcctgactacaaactctggctccgaggcngacggagtacgcgtgtattactactgctcgctactatgtagtcgtaaggttagttagttacgtttggtcggttcgggtcggagggaaccgtaacgcgtcccggtacccgttccgttacggtcgacgaaccgaacggtccgttccgtccccgttcgtcc

SEQ ID NO: 315233 - DNA, 557 bp, Homo sapiens
  misc_feature: GZ8MTXP01CBMQI.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctgtaccaacagcaccaggacaaacgcccccaaatcatgtatttatgaggcagtaagcgccctgtagggtttactaatcgtcttcctctgctccaagtctggcaacgaccgcctcctgacatctctgggctcgaggctaggaggacgagtctgtattattacgtgtactgctcatagtgacgtaggttagtagttagtttgggtggttcgggaacgggtacgggaccgtaagcgtacggtaccgttccgttggttaccaacggcccgaacggtcctccggacccccgtcgggttcctaacccg

SEQ ID NO: 315234 - DNA, 518 bp, Homo sapiens
  misc_feature: GZ8MTXP01A2WD7.45.79.H02.1.454.CMB.2.raw
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagacgcgatcgacacgaccggtgctcgatttagtgtcacacgaagggaaggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattanaactgtctctgtacacagcaccaggcaaagccccaaatcatgatttagngaggcagtacgcgcctgtaggttcatcgtctcctctgctcagtcngcacgcgctctnacatctcgtggactcgaggctagagacgagcgtagtattatactcgtcgtcgtctactatatgtacgtaggtagtacgttacgttacggttcggttcgggtcggacgggacgacgcgtacgtacgttccgttcgttacgaacgaccgaacgcgtcgcccgtccgttcgtcg

SEQ ID NO: 315235 - DNA, 631 bp, Homo sapiens
  misc_feature: GZ8MTXP01B1D51.45.79.H02.1.454.CMB.2.raw
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctcctgcacgtcggaaccngcagtgattgttggtatttactacttgtctctgtaccacngcaccagacaaacgcccccaaatcatgtatttagnggacggacaggtacgccgggtccctcggtagggtttactaagtcgtcttcctcgtggtcctcgaagtctcggccaacgtacccgggccctcccctaggaacctagtcctcgtgggaccctcgacggtctacggggacggacggtacgtctagtactttagtactcggtctcgtcctatagttagtcgacgtaaggtttaggttagtttacgggttttggttacgggttccggaagggtaacggttaccaggttcgtaacggccgttcgttagttccgaacggaccctaacggtccctccggccccgttaacggttccttaacccg

SEQ ID NO: 315236 - DNA, 568 bp, Homo sapiens
  misc_feature: GZ8MTXP01AKVZQ.45.79.H02.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctcgccctgactcagcctgcctccgtgtctggtctcctggacagtcgatcacatctctgcacgtgaaccagcagtgattggttggattactacttgtctctgacacngcaccngacaacgccccaatcatnattgngaggacagacgcgcctgtaggttcagtcgtcttccnctgctcagtcngcacgaccgtcctccgtgacactctcgtggcctcgaggctaggaggaccgagtctagtaactttacgtacgtgtcggtctctacagttagtcgtacgtagggttaacgttagtttcggtttcgggtcgggttcgggaacgggaacggttacaacggttcgtacggtcccgttcgttacggccaaccggtcccgaacggtcccgtcccgttccccgttcggttaacctcccg

SEQ ID NO: 315237 - DNA, 645 bp, Homo sapiens
  misc_feature: GZ8MTXP01DH9ML.45.79.H02.1.454.CMB.2.raw
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctcgtgtcgtggtctcctggacagtcatcaccatctctgcacgtggaaccngcagtgagttggttggattataccttgtctccgtggtaaccaacacgccaaccgagaccaaaccgccccaaatcatgtattagnggaggacaggtacgcggtcccgtacgttagggtttactaacgtcgtctttacctcgtgtacctacgaacgtcgtacggaaccaaaccgaccggtccctacccgtacgaactacttcccgtacgtcgggtacctcggaggtcgtacgggaacggtacggacgtcgtaagttaacttaacgttacgtcgtcggtatccgttactaagtagtcgagttaaggttaacgtttagttacggtttgggtcggtacgggcggtaaggaccgagttcgtaccggtacgttacgttacgaccgaacgcccgaacggtcccgcccgttccctcggttccttcccg

SEQ ID NO: 315238 - DNA, 539 bp, Homo sapiens
  misc_feature: GZ8MTXP01AUSVE.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctggtaccaanagcaccaggcaaacgcccccaaatcatgatttagtgaggcagtaagccggccctcgaggggtttctaatcgtcttcctctggctccaagtctggcaacaccggcctccctgacatcnctggctcgaggctgaggngagctgattatatgtctgctcatatgcgtaggttagtagttcgtttggtcggttgggcggtaggacgtaacggcgtaggtacccgttcgttcggttcgaacggccctaagggccctcggttcccccgtcggttcgtaacccg

SEQ ID NO: 315239 - DNA, 565 bp, Homo sapiens
  misc_feature: GZ8MTXP01C3793.45.79.H02.1.454.CMB.2.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcatcaccatctcctgcactgaaccngcagtgatggttggattatactgtctctgtacanagcaccagcaaacgccccaaatcatnatttangaggtcagtagcgtccctgtagggtttctaatcgtcttcctctggctacaagtctaggcaacgacgccctcctagactatcctacgtcgggcctacgaggcctaggacggtacgaggtctagactttaatctgtctcgtctnaagtntcgcgtaggtagtagttacgtttgggtcggttcggaacgggacggacgtaacgcgttacggacccgttcgaggttccgaacgaccccgtaagggtcctcccggttccccgtcggttcccttaacccg

SEQ ID NO: 315240 - DNA, 529 bp, Homo sapiens
  misc_feature: GZ8MTXP01B7YVQ.45.79.H02.1.454.CMB.2.raw
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccatgactcagcctgcctcgtgtctggtctcctggacagtcatcaccatctcctgcactggaaccngcagtgattggttagggagttataccttgtctcctggacaacngcaccaggcaaacgccccaatcatntattangaggcagtacgcgcctgtagggttcatcgtccttctcgtgctccaaagtctggaccaacgcgcctccngacatctcgtggctcgagcgtgaggcgagctgtatttatacgtgctgctactatgtgacgtaggtagttgttacgttgggtcggttcgggacgggaggtaccgagtcgtcgaccgttcgaggtccacggtcccgagtcccgttccgtccccgttcggtaaccc

SEQ ID NO: 315241 - DNA, 540 bp, Homo sapiens
  misc_feature: GZ8MTXP01EO1LP.45.79.H02.1.454.CMB.2.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcatggaaccngcagtgatgtggattatacttntctctgtacacagcaccagcaaacgccccaaatcatgatttangaggcagtagcggcctgtaggttctaatcgctttcnctgctcgagtctggcacgacggtcctcctgacactctcgtggactcgagtctagaggtacgagctgtacttattacgtcgtcgtgctctatagtcgctaggtagttagttacgtttgggcgttcgggaacgggtaggttacgagttcgtcgaacccgttcgttacggctaacggcccgtaacgccgtaccgccccgttaacggttcctaacccg

SEQ ID NO: 315242 - DNA, 709 bp, Homo sapiens
  misc_feature: GZ8MTXP01A70Z4.45.79.H02.1.454.CMB.2.raw
  modified_base (233)..(233): a, c, t, g, unknown or other
  misc_feature (233)..(233): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtcctcgtgactagtcactccactatcctctgacctacgtacgaaccngctagtgtagttgggtaggttaattacttaccgttctctcgtacgtaacacgacacccaccgaacgaaccaaaccccgacccctaactactatagttattagaggaggacgtacggacggtcccgtaccgtacgggttacggtttactacgtccgttccttcctcggtcgtacctacgacgttacgacgaactaaaccggcccgtaccctacgtaataaccgtacttcgtaccggtccggtcctacggcgacgtagggaacgggacgtagtacgtagttattaacgttcgtcgacggttctcttagattacggacggtaacggttaaggtttaacggtttcggtttaccggggtttgggtacggggtccgggaacgggtaacggacgtaaccgttcggtaacccggtccggttacgttcggcccgtaaccggacggtccgtcccgtacccgttccccgtaacggttcctaaccccg

SEQ ID NO: 315243 - DNA, 697 bp, Homo sapiens
  misc_feature: GZ8MTXP01AM5JS.45.79.H02.1.454.CMB.2.raw
  modified_base (298)..(298): a, c, t, g, unknown or other
  misc_feature (298)..(298): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctctgcacgtgaaccagcagtgagttgttggtattactacttgtctctgtacacagcaccagacaaacgccccaatcatcgatttangaggacagtaacgcgcctgtagggttctaatcgtcttcctcgtgtcctacgtaacgtccgtacgggccaaacgtacccgggcccttccctacgaactaaacttccgtcgttcgggtaccctccggtaagggtccgtagggaacgggtaccgtaggtccgtaggttaatttacgttacgttggcttacggtcttaaccagttaccgtggtacgtaaagggtttacggttaaggtttaccggtttgggggttaccgggtttcgggggaaccggggtaacggggttaaaccggtaacggttaccggttaccgggtacccgtttaccggttacgggttacccgaaccggaacccggtaacggttcccgacccggttccccgttaacggttcctttaaccccgg

SEQ ID NO: 315244 - DNA, 763 bp, Homo sapiens
  misc_feature: GZ8MTXP01C6RUI.45.79.H02.1.454.CMB.2.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcatcacntctctgcactcggaacngctagtgtagttggttagggtatttaactaaccttgtctcctcggtaaccaacacgaccacccgagaaccaaaccgacccccaaactacatagtaactttagtacggacggactaacggtaacgcccgggttaccctacggttacgggggtttactaaacgtcgtctttcccgtccgttcggtaccgtaccgtaacgttcctacgggaacctaaacccgacccgggtaccccttaccccgtacggtaaaccctaacgtttcccgttacggtttaccggggttacgtaacggggttcgtacggggaacggggtaacccggaggggttaccttaggttaaactttacgttaacgttacgtccggttacggtcttaaccggtaattaacggtgtaccggtaaagggtttagtttaacggggtttacgtttcgggtaacggtttcggggacggtaacgggaacacggtcgttaccgaccggtcgttacggttccgacgcccgtagtccgtacccgcccgttaccgtccttaacgtttccccg

SEQ ID NO: 315245 - DNA, 542 bp, Homo sapiens
  misc_feature: GZ8MTXP01DANWN.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtacanagcaccagcaaagcccccaaatcatgatttangaggcagtaagccggtcctcgagggtttctaatcgcttctctgctccaagtctggcaacacggcctccctgacaatctcgtgggcctccgaggctcggagcgaggctgattatactgctgctnagtatgctaggtagttagttacgtttgggtcgttcgggtccgggagggaccaaagctacggcccgttaccgttacggttcaacggcccaagggccctcggttacccccgtcggttccgtaacccg

SEQ ID NO: 315246 - DNA, 551 bp, Homo sapiens
  misc_feature: GZ8MTXP01AWV28.45.79.H02.1.454.CMB.2.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactggaaccagcagtgattgttagggattataacttgtctctggtaccaacagcaccaggacaaacgcccccaaatcatgatttangaggcagtagcggcctcgtagggtttcaatcgcttcctntggctcaagtctggcaacncgcctcctgacatctcgtggcctccgaggctggacggacgaggctgtattagtactgctgctcgatatgacgtaggtagtagttacgtttgggtcgttcggggcggtaacgggccaaaggttccgtacggacccgttcgttagggttccaacggcccgtaaggccctccggcccccgtggttcctaacccg

SEQ ID NO: 315247 - DNA, 743 bp, Homo sapiens
  misc_feature: GZ8MTXP01EQJ85.45.79.H02.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccatctcctgcactggaaccngcagtgatggtgggattatacttgtctctggtacaanagcaccagcaaacgccccaaatcatgatttagngaggacaggtaacgccggtcctacgtaggggtttacaagtccgtcgtttcctcgtcggactaccgtaaacgttccgtacgggcctaaaccgaacccgggtccccttaccccgttaaggacctaaacgttccgttcccggttaacgggggccctttacccggaagggttccgacggggtaaacggggtacccggaagggttccttagggttaactttaacggtttaccgtcgtaccgttcggtaaccgtttcctaagttaagtcggtaacggtaagggtttaacggttaacgtttccgttttaggggtacgggttcgggggtaaccgggtaagggggttaaccctaaagggttcccgttcgggtaacccggttaccgtttacgggaccgtaaccggccccgtaaagggtccccgtccggttaccccccgttcgggttcccttaacccg

SEQ ID NO: 315248 - DNA, 656 bp, Homo sapiens
  misc_feature: GZ8MTXP01CL9SY.45.79.H02.1.454.CMB.2.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactgaaccngcagtgatgttgggattatacttgtctctggtacacagacaccagacaaaccgccccaaatcatagtatttagnggaggacagtacgccggtcctacggtacgggtttctaacgtcgtcttcctcgtgtctacgtagtacgtacggcctaacgaccggcccttccgacgtaactaacgttccttacgtcgggtaccttccggaacgggcggttaacggaacgggaacggtaacggtcgtaaggttaacttaagttaccgttacggtcgttcggttactaccgttattacgtaccgtacgttaagggttacggtttagtttaccgtttgggggttcgtttcggggaacgggaacgggttaccgtaagttcggtaacggtaccgttacgttcggttacgccgtaccgaagtcccgtcgcccgtcgttctaaccg

SEQ ID NO: 315249 - DNA, 644 bp, Homo sapiens
  misc_feature: GZ8MTXP01BUS22.45.79.H02.1.454.CMB.2.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgatccacctatcctcctgcacgtacggaaccngcagtgagtggttagggtattactacttgtctcgtacgtacacnaccaccgagacaaaccgaccccaatcatgtatttagnggaggacagtacgccgccgtgtacggttcnctagtcgtccttctcgtcgtcctacgtaaacgttcgtaaggactaacggtacccgtccctccctacgactacgttctaccggtcggccgtccggtacgtaccgtaaggaacggtacgacggtacgttagtactttaagttacgaggtcacgtaacctataatttaacgttagtttacgtttacgtcccgtaagttccgggtagttccggggaacgtaacggacttacggttcgacccgtacgttacggttcgaccggtcccgacgtcccgcccgtaccccgttcgtccttcccgtccccg

SEQ ID NO: 315250 - DNA, 623 bp, Homo sapiens
  misc_feature: GZ8MTXP01DEOU0.45.79.H02.1.454.CMB.2.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaaggggggggtcacaagaggcagcgctctcgggacgtctccaccatgacctgggctctgctgctcctcactctcctcactcaggacacagggtcctgggcccagtctgccctgactcagcctgcctccgtgtctggtctcctggacagtcatcacatctccngcactgaaccngcagtnatggttaggattactacttgtctctgtacacacgcaccgagacaaacgaccccaatcatgtattagngaggacagtacgcgtcctagtaggttactatcgtcttcctcgtcgactacgaacgtctacgcaaccgaccggtccctaccgtacgaactacgtcctacgtggcctacgacggctagggaaggacgnggtactaggttaacttacgttaccgtgtcgtacgtacctataagttagtgcgttaaggttacgttagtttcgtttgggttcggttcggggaacgggtaacgggacgtaaacgttccgttaacgggtacccgttcgttacggaccgtaaccgacccgtaacggtccccgtacccgttccccgttaacgttcccgttaacccg

SEQ ID NO: 315251 - DNA, 629 bp, Homo sapiens
  misc_feature: GZ8MTXP01ANCIJ.45.79.H02.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (525)..(525): a, c, t, g, unknown or other
  misc_feature (525)..(525): n is a, c, g, or t
  modified_base (573)..(573): a, c, t, g, unknown or other
  misc_feature (573)..(573): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaangcaccaggaccaaacgcccccaaactcactgactttagtgagggtacaggtaacgccggccctcgtagggggtttactaagtcgtcttcctctggtctaccgtaagtcgttacgggccaaaccgacccgggtccctacccctgtacctaaactccgtcgtcgggcctcccgagggtcaggacgggaccgagggctaggactttaatctgtcctgctcaatagtgcgtaggtagttagttacgttgggttcggttcgggngggacggttaccaaggttccgtcgacccggttacccgttgggttaccnccggttacccggaacggtcccgttcccggccccccgttaacgggcccttaaccccg

SEQ ID NO: 315252 - DNA, 595 bp, Homo sapiens
  misc_feature: GZ8MTXP01CRP6L.45.79.H02.1.454.CMB.2.raw
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatgttagggattatacttgtctctgtacaacngcaccagcaaacgccccaaatcatnatttangaggcagtacgccggtcctcgtagggtttctaacgtcgtctttcctcgtcgtctaccaagtcgtcggaaccaaaccgaccgggcccttacctgaacctatcgtcgtcgggctccgagcgtaggaggacgagtctagtattacgtactgctgctagtaactgtgcgtaggttacttaggtttacgtttgggttacggttcggggaacgggtaaacgggctaaacggcgtacggaccgttacccgttggaccgtaacgcccgaacggtcccgtccgttaccccgttcggaacttccccgg

SEQ ID NO: 315253 - DNA, 659 bp, Homo sapiens
  misc_feature: GZ8MTXP01AZOFS.45.79.H02.1.454.CMB.2.raw
  modified_base (256)..(256): a, c, t, g, unknown or other
  misc_feature (256)..(256): n is a, c, g, or t
tcagacgcgatcgacacgaccggtgctcgatttagtgtcacacgaagggaaaggggggggtcgacaagaggcagcgctctcgggacgtctccaccatggcctgggctctgctgctcctcactctcctcactcaggacacagggtcctgggcccagtctgccctgactcagcctgcctcctgtctggtctcctggacagtcgatcaccatcccctgcacgtggactccgagcggtgtacgtttacttgtttttaagnttcgtctccgtggtatcagacaacaccgaggaccaaaaccgcccccaaactcattactaattttacagtattacgtaactaaattaacgtcccgggtacccttacgggttacgggggttttacctacgtacgttccggttccctttccgttcgttcggtaccctacccgtaaaagttccgtcgggtacctaaacgtacccgggtcccctacccgtacgtaccgtactcgtcgtcggctaccgagcgtagaacgacgacggtactagtaacttattacgtggactacgactactaatagttagttgttacgttctacggtcggttagtcgggaacggtacggacgtacgttcgtaccgtgttacgcacgccgacgtccgtccgcccgttcggtcttcgttcccg

SEQ ID NO: 315254 - DNA, 576 bp, Homo sapiens
  misc_feature: GZ8MTXP01EDKCD.45.79.H02.1.454.CMB.2.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacngtcgatcaccatctcctgcacgtgaaccagcagtgattgtagggattataactntctctgtacanancaccagcaaacgccccaactcatgatttangaggcagtaacgcgcctcgaggggtttctatcgcttccnctgctccagtcctgcaacncgtcctcctgacattctcgtcggctcgagctgacggacgaggctaggtacttattacgtgcgttcgcttctattagtcgtagtaggttaagttacgttaaggtttggtcgggtttcgggaacgggtaagggaccgtaagggttcgttacggacccggttacgttacggacccgaacggtacccgaacgggtcctacccgttccccgtccgttcccgttaacccg

SEQ ID NO: 315255 - DNA, 653 bp, Homo sapiens
  misc_feature: GZ8MTXP01B70NL.45.79.H02.1.454.CMB.2.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatcctctgctacgtcggaaccngcngtgagttggttagggtatttataccttgtctcgtagacaacagaccaccgagacaaacaccccaatcatgtattagngaggacaggtacgccgtcctacggtaggtttactacgtcgtcttccgtcgtcgctacgagtcgtagccaaacgtcccggccctaccgtagacctaagtcctcgtcggccttcggagcgtaaggacggtacggagtacgtattattacttacgtcgtcgtacgtcttacctagtagtacggtacgttaaggtttaagttggtttaaccgggtttgggtacgggttaccggggaacggggtaacgggttaccgtaggttaccgtacgggtacccgttacggttacggttacccgcgtaccccgtaaggtcccgtcccggttcccgttccgttaaccgtttccccg

SEQ ID NO: 315256 - DNA, 545 bp, Homo sapiens
  misc_feature: GZ8MTXP01E1TA3.45.79.H02.1.454.CMB.2.raw
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcatcaccatctcctgcactggaaccagcagtgattggttgggattataaccttgtctcctggtaccaacagccacccaggcaaacgcccccaaactcatgatttangaggcagtagcgcctgagggtttcatcgcttcctctgctccagtctggcaacgcgcctccctgacatctcgtcgggctcgaggctggaggacgagctgattntactgctgcttcaatagtgacgtaggttagttagttacgttttgggtcggttcggggcgggtaagggacccaagcgttacggacccgttcgttacggttcaacggcccaagggccctcggccccctcggttcctcccg

SEQ ID NO: 315257 - DNA, 604 bp, Homo sapiens
  misc_feature: GZ8MTXP01EOTLI.45.79.H02.1.454.CMB.2.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactgaaccngcagtgatgtaggattatactntctctgtaccacagcaccgagacaaacgcccccaaatcatgtatttagtgaggtacaggtaacgcccgtccctagtagggtttactaagtccgtcttccnccgtggcttccaacgtcgtcggcctaaaccgacccggtccctcccgtagaacctagtcctcgtggcctcgaggcctagggacggacgtaggcttagtattacttacgtgcgttgtacttactattaagtgacgttaggttaaacgttgttaccgtttggtacggttcgggaacggaaggacctagttcgtacggtacccgttcgttacggttccaacggtcccgaaggtccctccgccccgttcggttccttaacccg

SEQ ID NO: 315258 - DNA, 696 bp, Homo sapiens
  misc_feature: GZ8MTXP01EYO01.45.79.H02.1.454.CMB.2.raw
  modified_base (235)..(235): a, c, t, g, unknown or other
  misc_feature (235)..(235): n is a, c, g, or t
  modified_base (388)..(388): a, c, t, g, unknown or other
  misc_feature (388)..(388): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgagggtcctgggcccagtctgccctgactcagcctgcctccgtgtcgtgggtcctccgtggacagtcgatccaccatctctgctacgtaggaaccngctagtgtagttggttagggtaatttactaccttgtcctcgtacggtaaccaacacgcccaaccgaggaacctaaacccgaccccctaaatcaatgtaatttagaggagacaggtacgcccggtccttaggtaggtttacacgtcgtcttccncgtcggtcctacgagtcgacgaaccaacgtcccggcccttccgtagactacttccgtacggtggccctacgaggtcgacgggaacggacggtgtacgttaagttacttaacgttacgtcggtactcgtaccttagtaaagttgtcggtacgtttaaggtttaacgggtttaccgtttggggttcgggttaccgggaacggggaaccgggtaacgttacggaaccgtttcggacccggtaaccgttaccggttcgaccgcccggtaaccgtccgtcccgtacccgttcccgtaacgttaaccgtccccg

SEQ ID NO: 315259 - DNA, 465 bp, Homo sapiens
  misc_feature: GZ8MTXP01EZRXB.45.79.H02.1.454.CMB.2.raw
  modified_base (454)..(454): a, c, t, g, unknown or other
  misc_feature (454)..(454): n is a, c, g, or t
  modified_base (459)..(465): a, c, t, g, unknown or other
  misc_feature (459)..(465): n is a, c, g, or t
tcagacgcgatcgacacgaccggtgctcgatttagtgtcacacgaagggaaagggactggagtggattgggtatatctattacagtgggagcaccaactacaacccctccctcaagagtcgagtcaccatatcagtagacacgtccaaagaaccagttctccctgaagctgagctctgtgaccgctgcggacacggccgtgtattactgtgcgagagatcctaatacgtattacttgataggtaggggtagttttgatatcgtggggaccaaagggacaagtggtcacgtctcttcagcctccaccgaaggcccatcggtccttcccccgtggccacccctcctaccaagacgccacctcgtcgggggcacgacggccggccgtgggctcgccgtgggtcaaacgggtacctacttcctacgatcgcgtctgaggcgggcgtggcgaaggcganagagnnnnnnn

SEQ ID NO: 315260 - DNA, 645 bp, Homo sapiens
  misc_feature: GZ8MTXP01BND6S.45.79.H02.1.454.CMB.2.raw
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggactagtcgatccacctatcctcctgcacgtggaaccngcagtgtagtgtagggtattactacttgtctcgtgtacacagccaccagaccaaacgccccaaatcatgtattagtggaganagtacgccggtctcggtaggttactacgtctcttcctcgtcgtcctacgtacgtcgtacgaaccgaacccgtacccggtcccttacccgtagtaacctacgttcgtccgtcggtcctaccggtaggtcgtaggaaccgggtacggtacggtcgttaacgttagtttacgttacgtcgtactcgtactacgtagtagtacgtagttaaggttacggttagtttacgggtttggttacgggtcgggtaacggtacggacgtagcgtaccgtacgttcgttcgttaccgcgccgtaacgtcccgtaccgttcccgtaacgttccgtaacccg

SEQ ID NO: 315261 - DNA, 546 bp, Homo sapiens
  misc_feature: GZ8MTXP01CY1X4.45.79.H02.1.454.CMB.2.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacngtcgatcaccatctcctgcacgtggaaccngcagtgagtgttagggattatactgtctctgtacacngcaccagacaaacgccccaaatcatnattangaganagtagcgtccngtaggttanagtctctccgtcngtcctacgatcgtacgcaaccgacgcccttaccagaccatcgtcgnggcctacgngctaggaggcgtagctattagtaattcgtgctcgacttanagtgtgagttagttacgttgttgttggtcggtacgggaacggtacggacgtacgccgtacgtaccgttcgttacgccgtaacgccgaaccggtcctcccgttcccgtcgttccgccg

SEQ ID NO: 315262 - DNA, 717 bp, Homo sapiens
  misc_feature: GZ8MTXP01B34KE.45.79.H02.1.454.CMB.2.raw
  modified_base (270)..(270): a, c, t, g, unknown or other
  misc_feature (270)..(270): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccactctcctgcactggaaccagcagtgatgttgggagttataaccttgtctcctggtaccaaacngaccacccaggcaaacgcccccaaactcatgtatttatggagggcagtaaagccgggccctacgagggggtttactaactcgtcctttctacctcggtctccctaaagttccgttcgggccaaaccgacccgggcccttccccctagactaaacttccttccgtcgggtccgttacccaggggtcttaggacgggaaccgggtacggggcttacgggtatttactttaacgttcggcgttcgtccgttacctagtaaagttcggaccgttaagggttaaacggtttacggtttacggttttacggggttcgggttttccgggggaaccgggggtaacggggttacccggtaaagttccggttacggtaacccggttacccgttacggttacccgaaccgaccccggaacgtccggtccgttcccccccgtaagggttcctaaccccg

SEQ ID NO: 315263 - DNA, 532 bp, Homo sapiens
  misc_feature: GZ8MTXP01ALN35.45.79.H02.1.454.CMB.2.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacatctctgcactggaaccngcagtgatgttgggattactaacttgtctctggtaccaacngcacccaggacaaacgacccccaatcatgatttagngaggcagtagcggcctgtagggtttcaatcgcttcctcgtgctccgaagtctcggcacgacgctccctagacatcngtcggctcgaggtcaggaggacgngctagtattatactgctgtcctanagtngagtaggttagtagttgttggtcgggtcggaacggtacggacgtagttcgtacgtaccgttcgcgttccgcgaccgtaacgccgtccgcccgtcgttctccg

SEQ ID NO: 315264 - DNA, 595 bp, Homo sapiens
  misc_feature: GZ8MTXP01E1YA3.45.79.H02.1.454.CMB.2.raw
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccagcagtgatgttgggattatactgtctctgtacaangcaccagacaaacgccccaaatcatgtatttagngaggcagtaagccgcctcgtagggtttctaatcgtacttcctctggctacaagtctacggctaaaccgacgggccccttacccgtgaactaatccgttcgtgggtacctcgagtccgtggaaggacgggtaagtctagtaatttaatacgtcgtcggtatcctatatagtgtacgtaaggttagtacgttagtttggtcgggttacgggcgggtaacgggacaacggctacggtaacccgttccgttaaggccgaaccgcccgaacgtcgtaccccgccccgttcggttcctaacccg

SEQ ID NO: 315265 - DNA, 667 bp, Homo sapiens
  misc_feature: GZ8MTXP01ARNCU.45.79.H02.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (509)..(509): a, c, t, g, unknown or other
  misc_feature (509)..(509): n is a, c, g, or t
tcagacgcgatcgacacgaccggtgctcgatttagtgtcacacgaagggaaagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctctgcactggaaccngcagtgatggtgggattactaccttgtctctggtacacagcaccaggacaaaccgccccaaatcatgtaatttagnggaggacaaggtacggcccggtcccgttacggtacgggggtttacctaaacgtccgtcctttccccgtcgtcggtacctaccgaacggttcgtacgggaaccaaacccgtacccgggtccctttcccgacgtaacctaacttcgtccgtacggggaccttacccgggaggtccgtaggaacggacggtacgcttaggatttatacgngtctcgtctatactagtcgacgtagggttaacgttgttacggttcgggttacgggttcgggaacgggtaaggacccgtaaggttcgtccggtaaccgttcgttaacggccgaacgtaccgaacggtccctccgggttaccccgtgttaaccgtccccg

SEQ ID NO: 315266 - DNA, 766 bp, Homo sapiens
  misc_feature: GZ8MTXP01AD3ZZ.45.79.H02.1.454.CMB.2.raw
  modified_base (208)..(208): a, c, t, g, unknown or other
  misc_feature (208)..(208): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctccgtggacagtcgatcaccntcctctgcacgtgaaccagcagtgagtggttaggattataaccttgtctctggtaccacagcaccaggacaaacgccccaaactcatgtattangaggcagtacgcgccctgtacgggtttctaatcgtcttcctcgtggtcctacgaagttcgtacgggccaaaccgacccgggtcccttccccgtacggtaacctaaacgtccgttcccggtgggtcccttaccggacgggtcgttacgggaaacggggaccgggtagggtccgttaggttaacttttaaacgttaccgttcggtacgttacggtaccgttacctaacgtttagttcggaccgttaaagggggtttaaacgggtttaccgggtttaacgggtttttcgggggttaccggggttttaccgggggaaccggggtaaacgggggttacccgttaaacgggttccgttaccgggtaccccggtttacccggttacgggtttaccgaaccccgggtaccccgtaaccggggtcccgttacccgggttcccccccgtaacggttccccgttttaacccccgg

SEQ ID NO: 315267 - DNA, 725 bp, Homo sapiens
  misc_feature: GZ8MTXP01EO4F5.45.79.H02.1.454.CMB.2.raw
  modified_base (232)..(232): a, c, t, g, unknown or other
  misc_feature (232)..(232): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtcgtcgggtctccgtggacagtcgatcaccatctcctgcacgtggaaccngcagtgtagttggttagggtaatttactacttgtctccgtaggtacaacacgccaaccgaggaccaaaccgacccccaaatcatgtaacttagtggaggactaaggtaacggtcccgtccgttaggttacgggtttactaacgtcttcttacccgtcgtacggctaccgtaacgtcgtacgggaaccaaccgaccggtccctacccgtagtaaaccgtacttccgttcgggtcggtacccttccggagggttaccgtagggaaacccgggaagtacggttactaggttaaactttacgttaacgtcgtaccggttcggtaaccttagtaacgttaacgtcgttaacggggtaagtttaagggttacggtttaccgggtttggggtacggttcggggaaacgggtcggaaacgtaacgttcggtaaccggttaccgaacgttcggacgaaccggtaccgaacggtcccgtccgttaccccgtgttcccttcccg

SEQ ID NO: 315268 - DNA, 753 bp, Homo sapiens
  misc_feature: GZ8MTXP01D2ZGW.45.79.H02.1.454.CMB.2.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcatcaccatctcctgcactggaaccngcagtgatggttagggattataccttgtctcctaggtacaacagccacccaggaccaaacgacccccaaatcgatagtactttagtggaacggtacaaggtaacgcccgggtaccccttcgggtaacggggttttcctacgtaacgttccgtcccctttccgtcgtcggtcccttacccgtaaacgttcgtcggtacctaaacgtcccgggtcccccttacccgtacgtaaccctacttcccgtcgttccggggccttacccggaacgggtacttaacggaaacggtaacggcgggtactaggtaatttaagttaccctaggggacgtacgtacctaacgttaattaacgtttaacgtttagtttacggttttacccgtacggtttaccgggtaacggttccggggaacgggtaaccggttaacgttaaacgtttccggaaccgttaccggttacggcccgttaaaccgtccccggtaacggtcccgtcccggcccccgttcggttcccgttaaccctttccccg

SEQ ID NO: 315269 - DNA, 604 bp, Homo sapiens
  misc_feature: GZ8MTXP01BI1DG.45.79.H02.1.454.CMB.2.raw
  modified_base (310)..(310): a, c, t, g, unknown or other
  misc_feature (310)..(310): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattactaaccttgtctcctggtaccaacagcaccaggacaaacgcccccaaatcatgatttatgaggnagtagcgtcctgagggtttcatcgtcttctctggctcgaagtcgtgcacaccggccctcctagacatctcgtcggcctcgaggctggaacggcgaggtctagtattacttacncgtctcgctacattagcgtgtaggttacgttagttaccggtttgggtcgggttcggggcgggtaacgggttaccgtaacggttccgttacgggtacccggttaccgttcgggttaccgtaaccggaccccggtaacggtccccgtacccggttcccccgttcggttaacccgtttccccgg

SEQ ID NO: 315270 - DNA, 519 bp, Homo sapiens
  misc_feature: GZ8MTXP01EID6P.45.79.H02.1.454.CMB.2.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (415)..(415): a, c, t, g, unknown or other
  misc_feature (415)..(415): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtacaacagcaccaggcaaagcccccaaacncatgatttangaggcagtaagcgcctcgagggtttctaatcgcttctctggctccaagtctggcaacgcggacctcctgacaatctctggctcagctgaggcgagctgatatactgctgctcatangcgtaggtagtagtacgtttggttcgttcgggcggacgggttacaaggcgtagaccgttcgttaggttcaacgcccgaaggcctacgccccgtcgttcgtaacc

SEQ ID NO: 315271 - DNA, 559 bp, Homo sapiens
  misc_feature: GZ8MTXP01BKCD7.45.79.H02.1.454.CMB.2.raw
  modified_base (226)..(226): a, c, t, g, unknown or other
  misc_feature (226)..(226): n is a, c, g, or t
  modified_base (259)..(260): a, c, t, g, unknown or other
  misc_feature (259)..(260): n is a, c, g, or t
  modified_base (326)..(326): a, c, t, g, unknown or other
  misc_feature (326)..(326): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcatggaaccngcagtgatgttgggattatactgctctgtacanncaccagcaaagccccaaatcatgatttatgaggcagtaagcggcctgagggtttcaatcgcttccnctggctccaagtctggcaacaccgggtcctccctgacaattcctctgggcctccgaggtcctgacggacgaggctagattagttactgccgtgctacattactgacgtaggttagttaagttcgtttggtcggttcgggaacggtagggaccctaaggcgtacggtacccggttccgttgggttccaacgcccgtaacgggtccctcggttcccccgtcgggttcctaacccg

SEQ ID NO: 315272 - DNA, 790 bp, Homo sapiens
  misc_feature: GZ8MTXP01DHQ51.45.79.H02.1.454.CMB.2.raw
  modified_base (267)..(267): a, c, t, g, unknown or other
  misc_feature (267)..(267): n is a, c, g, or t
tcagacgcgatcgacacgaccggtgctcgatttagtgtcacacgaaggggaaaggggggggtcacaagaggcagcgctctcgggacgtctccaccatggcctgggctctgctattcctcaccctcctcactcagggcacagggtcctgggcccagtctgccctgactcagcctgcctcctgtctgggtctccgtggacagtcgatccaccactcccctgcctactggactccgaggtcggttagtacgtttacttagtttttaaagnttcgttctcgtggtatcacgaccaaaccacccgaaggaccaaaccgacccctaaatcaatacttaatttatagtatacgtaactaaagtaacgtccggtacccgttacggtttacgggtttctactacgttccgtcttctcccgtcggtactacgtaacgtcgtaacggactaacgtccgtccctacctacgtaccctcgtccgtccggtcggtccctaccgacgggtacgtaacgggtaaacggacggtacggtcttaacgttaacttacgttaacgcggtactaacggggtactaaacgttaatttaacgttaacgtttacgtttaccgtttacccgtaacgggtttcccgggttaagggttccggggaaccggggttaaacgggtaaacccgttacggttaccggttaaccggttacccggttaacgtcccggaaccgttcccgggttaaccggtccccgtaccccggtccccgtttaccggtaccttacccgttcccgtttaaccccgtttaacccccg

SEQ ID NO: 315273 - DNA, 780 bp, Homo sapiens
  misc_feature: GZ8MTXP01AX2C1.45.79.H02.1.454.CMB.2.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatccaccatccnctgcacgtggaaccngcagtgagtggtggacttatacgttgtctcgtgtacangccacgaggtacaaacgccccaaatctatacgtattagngacggtacgagtacgccgtacgtacgtacgggtttactaagtcgtcttacccgtgcgtctaccaggttacncgggaacctaacctacccgggtcccttacccgtaggtaacctaaacgttcccgtacggtacggtacccggtacggtaacgggtccgttaacgggaaccggggtaaccgggttacggtacgtttaaacgttacgttttaaaacgtttaccggtaccggttaccggggttcgtaccccggttaacttaaggttaacgtccgggttaaccgttaaagggtttaccgtttacgggttaacggttttgggtacccggggttacggggttccggggaaacgggttaacccggaacgggttcccgtaaccgggttcccgttaaaccggttcgggttaacccgaaccgggttaaccccgtcgggttcccgtccccgggttaccccgtttccgggttaaccgttaaccccggg

SEQ ID NO: 315274 - DNA, 677 bp, Homo sapiens
  misc_feature: GZ8MTXP01C5FSI.45.79.H02.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcatccaccatctcctgcactgaacngcagtgatgtggattatacttgtctctaggtaccacagccaccgaggaccaaacgacccccaaatcatgtattagngaggnagtagccgcctgtaggttacagtcgtacttctcgtgctccagtcngcacgccgccctcacgactactcgtacgtcggtactacgagggtactagggaacggacgtacgggtacttacgtaacgtttaacgtttacgtcgttacggttacgtacttaaccgttaagttagtacgacggtttaaagggtttaaacggtttaacgggttttacggttttagggggtaccgggtttacgggggaaccggggtaacgggaaaccgttacggttacccgttacgggtaaccccggttccgttacgggacccgtaaccgggaaccccgtaaccgggtcccggtccccgttacccccggttccgttccgttaaccccg

SEQ ID NO: 315275 - DNA, 778 bp, Homo sapiens
  misc_feature: GZ8MTXP01AWAVK.45.79.H02.1.454.CMB.2.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctctggacagtcgatcacatctcctgcactcggaaccagcagtgattggttaggattataaccttgtctctaggtacaacagccaccaggaccaaaccgacccccaaatcgatagtatttagtgaggacaggtaacgccggtccctacggtagggtttactaagttcgtcctttacccgtcgtacggtccttaccgtaacgtccgttcgggaacccaaaaccgcccgggtaccccttcccccgttagaaacccttaacgttcccgtacgttcgggtcccgttcccgaacgggtcttacggggaaacggaaccgggtacggtaccgttacggttaattttaaactttacccgtggtaccgtcggtacttaccggtaattacgtacggtacggttaaagggtttaaggtttaccggttttaagggttttcgggtttacggggtttaacccggggtaacgggggaaacgggttaaacccggaaacgttccggtaaccgggtaccccgttaccgggttaacggttacccgaacccggttaccggaaccgggtcccgtccccgggttaccccccgttgggttaaccccttccccgg

SEQ ID NO: 315276 - DNA, 634 bp, Homo sapiens
  misc_feature: GZ8MTXP01C0FNC.45.79.H02.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcatcacatctcctgcactgaaccngcagtgatggtaggattatactgtctctgtaccanancaccagacaaacaccccaaatcatagtatttagagagganaggtaagccggtccgtacgtagggtttctaactcgtcttcctactcggacctaccgtaagtccgtcggaacaaacccgtacccgggtacccctacccgtagtaacctaacgtccctacggtccggtcctccgacggtcgtaggaaggacggtaggtcgtaagttagttaactcgtcgtcggtagtctacagttagtcgtgtaggttaagttcgttacggtttggtacggtttcgggaacgggtacggactacgttcgtcgtaaccgttccgttcggttaccggccacccgtaacggtcccgtccccggttccccgttccggttaaccgttccccg

SEQ ID NO: 315277 - DNA, 645 bp, Homo sapiens
  misc_feature: GZ8MTXP01C4MAH.45.79.H02.1.454.CMB.2.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (510)..(510): a, c, t, g, unknown or other
  misc_feature (510)..(510): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccatctcctgctagtcggaaccngcagtgtatggttgggattaactacttgtctcgtagtaaccacacgaccaccaagtaccaaacgcccccaaatcaatcgtatttagtgaggtacaaggtacgtcccggtacctacggtaggggtttactaagtcgtacttcctcgtacggtcctaccgtaacgtctacggccaaacgaccggtccctaccctagaactaacgtctacgtggctaccgaggctaggacggaacggtgtccgttagtactttaagttactcgtcggtcgtccttagaactttancggacgttaggttaagttacgtttcgtttaggtccggttgggaacggacggggttaacctaagttccgtaaggtaccccgttcgttcggacaaccggtaccgtaaggtcctccggccccgttggttccgtaaccc

SEQ ID NO: 315278 - DNA, 735 bp, Homo sapiens
  misc_feature: GZ8MTXP01DB5H4.45.79.H02.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacngtcatcaccntcnctgcactggaaccngcagtgatggtggattatacttntctctgtacangcaccagacaaacgccccaatcatgtatttagnggaggnagtaagccggtcctacgtagggtttctaagtcgtactttccgtctaggtcctacctaacggtccgttacgggaaccctaaaccggtacccgggtaccccttaccccgtacggaaacccttaacggtcccttaccgggttcggggacccttccggacgggtaccgtagggaaacgggtacgtacgggtccttaggttaacttacgttaacgtcgtacttcggtacccttactaagttacgtggtaaccgttaggggtttaaacgtttaggtttaacggttttaccggggtgggtttacccgggggtaacgggaacgggttaacccgtaaacggttccgttaccgggtaacccggtttaccgttacgggttacccgaaccggttacccgaacggtcccgttacccggttacccccgtttgggttccccgtttaaccccgg

SEQ ID NO: 315279 - DNA, 649 bp, Homo sapiens
  misc_feature: GZ8MTXP01EQMCP.45.79.H02.1.454.CMB.2.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (259)..(260): a, c, t, g, unknown or other
  misc_feature (259)..(260): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagacgcgatcgacacgaccggtgctcgatttagtgtcacacgaagggaaaggggggggtcacaagaggcagcgctctcgggacgtctccaccatggcctgtgctctgctgctcctcactctcctcactcaggacacagggtcctgggcccagtctgccctgactcagcctgcctcgtgtcgtggtctcctggacagtcatccaccatcctcctgcactggaaccngcagtgatggtggattatactntctctgacanncaccagacaacgccccaancatnattangaggcagtacgcgtcctgtaggttcaactcgtccttctcgtgtcctaccgaaagttcctggaccaaaccgaccggtcccctacccgtagaactaacgttcctacgtcgggtacctaccgagggtccgttagggaacgggtacgagggtaccttaggttaaactttacgttaccgtacggggcttacgtcctacctagttaagtccgtacgttaaagggtttgttaacggtttaacggtttgggtcgggttaacgggacgggttaaacggacccgttaaaggtccgttacggttacccggttcgacggttccgaaaccggcccggtaacggtcccttacccgtcccccgtttcggtaacccc

SEQ ID NO: 315280 - DNA, 684 bp, Homo sapiens
  misc_feature: GZ8MTXP01DBJY1.45.79.H02.1.454.CMB.2.raw
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctctgcatcggaaccngctagtgtagtggttagggatttaactacctttgtctccgtaggtaccaanacgccaaccaggacaaaccgacccccaaatcatgtatttagngaggactaggaacgtccggtccgtacggttagggtttacctaagtcgtactttccgtctcgtccgtactaacgtcgttacgggccaaacgcccgggtacccttacccgacggtaaccctaaacgttccgtccgtcgggtccgtaaccgtcggacgtacgggaaggcggaagtcgtagtattattaacgcggttctcgtactacctaagtattcggtagttacggttaaaaggtttgttaacggtttcgggtacgggtttcggggaacgggtaaacgggaccgtacgggttacgttaccgggtccgttaacgttccggttacgaaccgtaccgaacggtccgtccgttcccgtccggttaacttcccg

SEQ ID NO: 315281 - DNA, 620 bp, Homo sapiens
  misc_feature: GZ8MTXP01CPCZY.45.79.H02.1.454.CMB.2.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctcctgcacgtggaaccngcagtgatggtaggattactactgtctctgtacanagcaccgagacaaacgaccccaaatcatcgtatttagaggaggacagtaacgccggtcccgtacgtagggtttactaacgtcgtctttcccgtcgtcggctaccgaagtccgtacgcctaaaccgaccggtcccttccgagaactactcgtcgtcggctccggagtcgtaggacggtacgagtcgttagtattacttacgtgcgttctactatagtacgtgtacgtaggttagttacggtttaggttggtcgggtcgggaacgggtaacggaacgtacgttcgtaccggtaccgttacggttcgttaccgaacgtaccgaacgtcccgtcccgttccccgtaaccgttccgtccg

SEQ ID NO: 315282 - DNA, 586 bp, Homo sapiens
  misc_feature: GZ8MTXP01EZFBC.45.79.H02.1.454.CMB.2.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccntctcctgcactggaaccngcagtgatggttagggattactacttgtctcgtagtaccaacacgccaccgagaccaaaccgaccccaaatcaatgtatttagtggaggacaggtaacgccgaccgtgtaggtttactaagtcgtcttcctcgtgtctcgacgtctcggcacgaccgtccctccgtagactatctcgtcggctccgngctaggacgacggagtcgtanacttaatacgtgctgtctactatagtcgagttaaggtagttaagttcggtttggtcggttcggggaacggtaacgggacaacggttcgtcggtaaccgttcgttacgttccaaccggacgtaacgtcctcccggttcccctcggttccttcccg

SEQ ID NO: 315283 - DNA, 672 bp, Homo sapiens
  misc_feature: GZ8MTXP01DRA7E.45.79.H02.1.454.CMB.2.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacgagggtcctgggcccagtctgccctgactcagcctgcctccgtgtcgtggtctccgtggacagtcgatcaccatcctcctgcacgtggaaccngcagtgtagttggttagggtaatttactaaccttgtcctcgtaggtaccaanacgccaaccaggaccaaaccgacccccaaatcatgtatttagnggaggcagacgcgtccgtgtagggttactaagtcgtcttccgtcgtcgtacctacgtaacgttcgacgaacctaccgtacccggtccctaccgtagtaactacgtccgttacggtcggtcctaccggacggtcgtacgggaacggtaccgtaggtacttagttattacgttacgtcgtacttgtaccttaatacgtagtgtaacggttaaaggtttacgggtttaacgttgggtttcgggtcggttcgggggaaacggtacggaacgtaacgttcgtaccgtaccggttacgttgacccgaacggtacccgaacggtcccgccgttccccgtcgttccgttccccg

SEQ ID NO: 315284 - DNA, 624 bp, Homo sapiens
  misc_feature: GZ8MTXP01ANN0L.45.79.H02.1.454.CMB.2.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (480)..(480): a, c, t, g, unknown or other
  misc_feature (480)..(480): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtgaaccngcagtgattggttagggattataaccgttgtctctaggtaccaacacgccaccgagaccaaacgacccccaaatcatgtattangaggnagtagcgtcctgtaggtttacaatcgtcttccctgcggtcctacgaacgtcgacgaacctaaaccgccgtccccgtaccctacgactaaacgttcgtcgtcgggcctacgacggtcgtaggacgggaacgcgggtctagttattactacgtgtctagtcttacngtatcgattaggttagtagttccgttggggtcggttcgggaacgggtaacggaccgtaacggttcgtacggtacccgttacggttcggacgaacggtaccccgtaacgtccgtcccggttaccccgttcggttcttaaccccgg

SEQ ID NO: 315285 - DNA, 660 bp, Homo sapiens
  misc_feature: GZ8MTXP01B7PTZ.45.79.H02.1.454.CMB.2.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtcctgccctgactcagcctgcctccgtgtctgggtctcctggacngtcatcacatctctgcactggaaccagcagtgagttggttagggtattactaacttgtctcgtagacaacagcaccagcaaaccgccccaaatcatntatttagnggagganagtacggccgtcctcggtaggtttactatcgttctcccgtcgtcgctaccgtacgtctacgccaccgaccgtccctaccgtagaactacgttcctcggtcggtcctccgagggtcctagggaacggacggtaggtatacgttatttaagttccgtgtccgtgtaccttatagtacgtaggtacgtaagggtttacgtttagtttcgggttttcggggtacggttccgggggaacggggtacggttaaaccggtacgttcggttaccggtacccggttaccgtttacggccgtaaccgggaacccgccggttcccgtcccgttcccccgttaacggttccctttccccgg

SEQ ID NO: 315286 - DNA, 556 bp, Homo sapiens
  misc_feature: GZ8MTXP01DNMC0.45.79.H02.1.454.CMB.2.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccatctcctgcactggaaccagcagtgagttggttgggattataaccttgtctctgtaccaacagcaccagacaaacgaccccaaatcatgtatttangaggacagtaagcgcctcgtagggtttctaatcgtcttcctctgctacaagtctagcaacaccggcctccctagactaatcctcgtcggcctccgaggcctaggaggacgaggctgtattagttatcgctgctacatagtgcgtaggttaacgttagttcgtttgggtcgttcgggaacgggaggaccaagttcgtacggtacttccgttagccaacgccgaacggcctaccgccccgtaacggcttaacccg

SEQ ID NO: 315287 - DNA, 669 bp, Homo sapiens
  misc_feature: GZ8MTXP01EEJH8.45.79.H02.1.454.CMB.2.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgatcaccatcctcctgcacgtcggaaaccngcagtgagttggttaggtattatactntctctagacanacncacgacgacaacgacccaatcatgtattagagagacgtagtacgccgtccgtacggttaggttactagtcgtcttcccgtcgtcgtactacgtagtcgacgcgtaaccgccgtccctaccgtagacgtactctcgtacgtccncgagtcgaggacggacgtagtctagttaacttacgttacgtacgtacgttcgtaacttagtaacttagtcgtaacggttaagggttaagtttaaccggtttacgggtttcgggtacggtaacggggtaacgggtaaccgggttaacgtaacggttccggttaccgggtaacccggttacggttaaccggaccgtaaccgtacccggaacgttccccgtaccccgggttacccccgttaacggttcccgtaacccg

SEQ ID NO: 315288 - DNA, 916 bp, Homo sapiens
  misc_feature: GZ8MTXP01C5RGZ.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgtagtggttagggtatttaactaccttgtccgttctacggtaaccaacacgaccacccgaacgaccaaaacccgtaccccccaaaattcctaaagttacggtaactttttaaggacgggtaaacgggaccgtaaacggtaaaccggtcccgggttaccccgttacggtttaacgggggttttacctaaacgttccgttcctttcccgtccggttacggtacctacccgtaaacggttcccgttacgggaacccgtaaaaccgtccccgggtacccttacccctacgggtaaaccttaaaccgtccggtacccggttcggggtacccttacccgggaggggttccgtaagggggaacggggtaacgtacggggttacttaacggttaaattttacgttaaccgtcgggtcggttacgtaccgttaactaagttacggtacggtaccgttaaggggtttaaggtttaacccggtttacgggtttttaggggtaccggggtttccgggggaaaacggggttaaccggggaaccgttaaaccggggttccgtttaaacccgggtccccggtttaaaaccgggttccggttaaaccccgggaacccggtaacccccggtaacgggggttcccccgttccccggggttaaccccccggtttaacccggggttccccttttaaccccccggg

SEQ ID NO: 315289 - DNA, 586 bp, Homo sapiens
  misc_feature: GZ8MTXP01A6803.45.79.H02.1.454.CMB.2.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctctgcactggaaccagcagtgattggtgggattactacttgtctctggtacacacgcaccgacgacaaacgacccccaaactcatacgtatttagtggaggctaggtaacgccggcccgtacggtagggtttactagtcgtcttcctcgtcgctactacgtctacggcaaccgccggtccctccgtagactactctcgtcgcctcgtaggctgaacggagaggtctagtattacttactcgtctcgtcttatatagtgtcgtaggttagttagtttacggtttgggtacgggttcgggaacgggacgggttacctaggttcgtacgtacgttcgttagttcgaagtccaagtccgtccgttcccgtgttaactccg

SEQ ID NO: 315290 - DNA, 685 bp, Homo sapiens
  misc_feature: GZ8MTXP01B0SIJ.45.79.H02.1.454.CMB.2.raw
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcacatctcctgcactggaaccngcagtgatgtggattatactgtctctgtacanancaccagacaaacgccccaaatcatgatttagngaggcagacgcgcctgtaggtttctatcgtctcctctggctacgacgtcgtcgggctaaaccgccgggtccctaccgtacgtactaactccgtcgtacgggtcctacccggagggtccgtagggtaaccgggacgtacggtaccttaggtaactttaacggttactcgggtacctacggtcctacgttagttaccgtggtaacgttagggggttaacgttacgggtttaaaccggttttggggtcgggtttaacccgggaacggggttaaccggaaccgtaacggttaccgttacccgggtacccggtttacccggttcggttaaccccggaacgttaaccccggaacgggttccgtaccccggttacccccgttcgggttaaccccttaaccccg

SEQ ID NO: 315291 - DNA, 719 bp, Homo sapiens
  misc_feature: GZ8MTXP01BR1SK.45.79.H02.1.454.CMB.2.raw
  modified_base (241)..(241): a, c, t, g, unknown or other
  misc_feature (241)..(241): n is a, c, g, or t
  modified_base (573)..(573): a, c, t, g, unknown or other
  misc_feature (573)..(573): n is a, c, g, or t
tcagacgcgatcgacacgaccggtgctcgatttagtgtcacacgaaggggaaagggggggggtcacaagaggcagcgctctcgggacgtctccaccatggcctgggctctgctgctcctcactctcctcactcaggacacgagggtcctgggcccagtctcgccctgactcagcctgcctccgtgtcgtggtcctccgtggacagtcgactccacctctcctcgtgccacgtacggaaccngactagtgtagttggttagggtaactttactaacgttcgtctacgtacggtaaccacgacgaccctaacccgaacggtaaccaaacccgacccccctaaatccgtaagttacgtacgtttaaggtacggacggtacgacggttacggcccgttcccggtaggtacgggtttatacgtcgtcttacgtccggtcgtacctacgtacgtcgacgaaccgaccgtaccgtcccgtaccgtagtaactacgtcgtacggtgcccgtacgcgggtaccgtgggaaccggtacgtacgttacgtagttactttaacgtacgtcggtctacggtacctntaagtcgtgtaacggttagttacggtttcgttacggttcgggtggtacgggaacggtacggttcgtacgttcggtaccgtccgttacgttcgggttacccaacgggtacccgtcgtcccgtccggttaccccgtcgttcgttcccg

SEQ ID NO: 315292 - DNA, 618 bp, Homo sapiens
  misc_feature: GZ8MTXP01AVAUV.45.79.H02.1.454.CMB.2.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (463)..(463): a, c, t, g, unknown or other
  misc_feature (463)..(463): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccntctcctgcactggaaccngcagtgatggttagggattactacttgtctctgaccanagcaccagaccaaacgccccaatcatgatttagngaggacagtagccgtccctgtacgggttctaagtcgtactttccnctggaccttaccgaagtcctacggccaaacgccggtcctcccgtgaactactcctacgtcggccgtaccaggctaggaggtaccgaggtctgtaattacttacgtgctgctctagttancgagtaggttagtacggttacgtttggtcggtcggtaacgggaagttaccgtaacggttcgtacgggtacccgttaccgttacggttaccgaacccgggtaaccccggtaacgtcccggttccccgaccccgggtttcgttaaccccgtttcccg

SEQ ID NO: 315293 - DNA, 687 bp, Homo sapiens
  misc_feature: GZ8MTXP01D8L9R.45.79.H02.1.454.CMB.2.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
tcagacgcgatcgacacgaccggtgctcgatttagtgtcacacgaaggggaaagggggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcgatcacntctctgcactgaacngcagtnagttgtgggattactacttgtctacgtgtaaccaancacaccgaggaccaaaccgaccccctaaatcaattagtatttaagnggaacgganacggtaacgccggtaccctacgggtaggtttctaacgtccgtacttttcgcgttggaccctacgtaaacgtccgtagggaaccctaaaccgtacccggtcccttacccagtaacctagttccctacgtcgggtcctaccgagcggtagacgggacggtagtacgttacggtaatttacttaagtccgtactacgttacctacgttaagtacgttacgcgttaagggttacgttaagtttccgttgggttacgggtacccggaaggggtacgacccgtaaggttcccgttacggtaccggttccgttaaacgttccgaacggtaccgaacgtcccggtaccgttcccgttaaccgccgttaaccc

SEQ ID NO: 315294 - DNA, 580 bp, Homo sapiens
  misc_feature: GZ8MTXP01BYC9G.45.79.H02.1.454.CMB.2.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctctggacngtcgatcacatctctgcatggaaccngcagtgatgttgggattatacttgtctctgtaccaangcaccagcaaacgccccaaatcatgatttangacggacagtacgccggtcctgagggtttacaatcagtttcccngttgctaccgagtcctggccaacncggcctcctgactagtctctggctcgagctggacgacgacgtctagtattaatctagcttcggtcttacctagtagttcgaccgttaggttagttacgtttacggttcggttgggtaccgggtgggaacgggttacctaaggttccgtaacggtaccgttccgttaggccgaacggtacccctaagggtccgtaccgttccccggttcgttccgttaacccgg

SEQ ID NO: 315295 - DNA, 503 bp, Homo sapiens
  misc_feature: GZ8MTXP02GEVBZ.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaatcatgatttatgaggcagtaagcggccctcaggggtttcaatcgcttcctctgctccaagtctgggcaacacggcctccctgacaatctctgggctccaggctgaggacaggctgattatactgctgctcatatgctaggtatagtactttggtgttcggcggtaggaccaagctgaccgtctaggtcaagcccaaggctcgcccctggtctacg

SEQ ID NO: 315296 - DNA, 525 bp, Homo sapiens
  misc_feature: GZ8MTXP02IU6VE.45.79.H02.1.454.CMB.2.raw
  modified_base (366)..(366): a, c, t, g, unknown or other
  misc_feature (366)..(366): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattataactgtctctgtacaacagcaccaggcaaagcccccaaactcatgatttatgaggcagtaagcggcctgagggtttctaatcgcttctctgctcagtctggcaacacggcctccctgacaatcnctggctccaggctgaggacgaggctgattattactgtctgtctcatactgctaggtagtaagttcgtttgggtgtttcggacgggtagggaccctaaaggctacggacccgttcgtaggttccaacgcccgaaggtcctcggccccctcggtcctaccg

SEQ ID NO: 315297 - DNA, 424 bp, Homo sapiens
  misc_feature: GZ8MTXP02H0AN5.45.79.H02.1.454.CMB.2.raw
  modified_base (421)..(424): a, c, t, g, unknown or other
  misc_feature (421)..(424): n is a, c, g, or t
tcagacgcgatcgacacgaccggtgctcgatttagtgtcacacgaagggaaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtagggattttgatatctggggccaagggacaatggtcaccgtctcttcagcctcaccaaggcccatcggtctccccctggcaccctctccaagagcacctctggggcacagcgcccctgggctgcctggtcaaggactacttcctcgatcgcgtctgagcgggctggcaaggcgcatagnnnn

SEQ ID NO: 315298 - DNA, 658 bp, Homo sapiens
  misc_feature: GZ8MTXP02JNZCA.45.79.H02.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattatactgtctctgtacacngcaccaggcaaacgccccaaactcatgatttangaggcagtaagcgcctgtagggttctaatcgtcttcctcgtggctaccagtctgggccaaccgacggccctcccgtgacacttcctcgtcgggtcctcccgaaggcgtaggacggaccggaggtctaggtactttacttacgtgtcgttcggtctacgtaattagtagtacgtaagggttaacgttaggtttacgttttaggggttcgggttcggggtacggggtacggggtaaccgtaaacgggtccgttaccggggtaaccccggttaccggttaacggggttacccgtaaccggtaccccggaaaacgggttcccggttaccccggaccccccggtttcggggttaaccctttacccccgg

SEQ ID NO: 315299 - DNA, 491 bp, Homo sapiens
  misc_feature: GZ8MTXP02GVWWC.45.79.H02.1.454.CMB.2.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaatcatgatttangatgtcagtaatcggcctcaggggtttcngatccgcttctctggctccaagtctggcaacaccggcctccctgacccatctctgggctcaggctgaggacgagctgattatactgcagctcattangcacnagcatcgactctagtacgtcggacggacggacagcgtcgaccgtctaggcacgaccgaag

SEQ ID NO: 315300 - DNA, 497 bp, Homo sapiens
  misc_feature: GZ8MTXP02HWZT0.45.79.H02.1.454.CMB.2.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctctgtacangcaccagcaaagccccaaatcatgattangaggcagtaagcgcctnaggggtttctaatcgcttcctctgctcaagtctggcaacacggcctcctgacaatcnctggctcagctgaggacgaggctgtattatactgctgctcatatgcaggttagtagtacgtttgggtgttcggcggagggtaccaagcgttcgaccgtcgtaggtcaagcccaaggcctcgccccctggtacctccg

SEQ ID NO: 315301 - DNA, 538 bp, Homo sapiens
  misc_feature: GZ8MTXP02G46J8.45.79.H02.1.454.CMB.2.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatactgtctctgtaccangcaccagcaaagccccaaatcatgatttangaggcagtaagcggcctcgagggtttcaatcgcttcctctgctccaagtctggcaacacggcctccctgacatctctggctccaggctgaggacgaggctgattatacngctgctcatatgcgaggttagtagttacgtttgggtcgtttcgggcgggtacgggaccaaaggtcgttacggacccggttcctaagggttccaaacggtccccgaaagggcctaccggtcccccctaggggtcctacccg

SEQ ID NO: 315302 - DNA, 509 bp, Homo sapiens
  misc_feature: GZ8MTXP02HGRKG.45.79.H02.1.454.CMB.2.raw
  modified_base (225)..(225): a, c, t, g, unknown or other
  misc_feature (225)..(225): n is a, c, g, or t
  modified_base (455)..(455): a, c, t, g, unknown or other
  misc_feature (455)..(455): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggggattataacttgtctcctggtaccaacagcacccaggcaaagcccccaaaactcatgatttatgaggcagtaagcggccatcaggggtttctaatcgcttctctggctcaagtctggcaacacggcctccctgacaatctctggctccgaggctgaggacgaggctgattattactgcttgcttcatatgctaggtagtgtactttggtgttcggnggtaggaccaagcgtcgaccgtcctagcgacgcccgaagctcgcccctcggtcc

SEQ ID NO: 315303 - DNA, 533 bp, Homo sapiens
  misc_feature: GZ8MTXP02GCMXU.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcaccaggcaaagcccccaaatcatgatttatgaggcagtaagcggccctgaggggtttcaaatcgcttcctctggctccaagtctggcaacacggcctccctgacaatctctgggctccaggctgaggacgaggctgattattactgctgctcatatgcaggtagtagttacgtttggtgttcggacgggtaggaccctaaaggctacggacccgttaccgtaaggtcaacggccccaaagggccttcggccccctcggtctaccg

SEQ ID NO: 315304 - DNA, 535 bp, Homo sapiens
  misc_feature: GZ8MTXP02JT50A.45.79.H02.1.454.CMB.2.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (439)..(439): a, c, t, g, unknown or other
  misc_feature (439)..(439): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctctgtacangcaccagcaaacgccccaaatcatgatttatgaggcagtaagcgcctcgagggtttcaatcgtcttcctctggctccaagtccgtggccaacgaccggccctcccgtagaacctaaatcctcgtacggggcctcccgaggctggacggacgaggctagattattactgctgcttacattagngagtaggtagttagttacgttggtcggtcggacggaggaccagtcgtacgaccgtcgtacgtacgaacgaccgacggtcctccgcccgtcgctacg

SEQ ID NO: 315305 - DNA, 562 bp, Homo sapiens
  misc_feature: GZ8MTXP02GFMTE.45.79.H02.1.454.CMB.2.raw
  modified_base (335)..(335): a, c, t, g, unknown or other
  misc_feature (335)..(335): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggattttagtttgtctctggtaccaacaacaccccggcgaacgcccccaaataatcatttataggacactaagcggcctcggggtttcaagtcgcttcnctgctcaagtctggcacacgcctccctgacatctctgggcctccaggctcaggacgaggctgattatttctgttgctcatatgcagggaccagcagtttgggtcgttcgggcggtagggaccgtagggttacggaccgttccgtaagggtccaacggcccgaaagggcctccgccccctcgggttcccaaccgttcctcggttccccacccttcctcctacggtacc

SEQ ID NO: 315306 - DNA, 516 bp, Homo sapiens
  misc_feature: GZ8MTXP02J0I6G.45.79.H02.1.454.CMB.2.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttatgaggcagtaagcggccctcgaggggtttctaatcgcttcctctggctccaagtctggcaacacggcctcctgacaatctctgggctccaggctgaggacgaggctgattatactgctgctcatatgctaggtagtagtacgtttggtggttcggcggtaggaccaaggctacgaccgtcctaggtcaagcccaaggcctcgccccctcggctaccg

SEQ ID NO: 315307 - DNA, 643 bp, Homo sapiens
  misc_feature: GZ8MTXP02G92QE.45.79.H02.1.454.CMB.2.raw
  modified_base (295)..(295): a, c, t, g, unknown or other
  misc_feature (295)..(295): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctctgcactggaaccgcagtgattggttggattataacttgtctctggtaccaacagcaccaggcaaacgccccaaatcatgactttangaggcagtaagcgcctgtaggggtttactaagtcgtcttacctcgtcggctcgaagttctaggccaaacgtcggccttacccgtagacaaacttccgtcgtacggggccttacccgaacgggtcttacggaacggtaccgtacgggtacttacgtaacgtttaacgttaaccgttacggtccgtttacgtaccgttacctaagttacgttacgtaccgaaccgggttacaaccggtactaagtacggtaaccttacgttaacggttagttaccgggacggtaacggggacctaagtccgtacgtaaccggtacgtaacggtccaaacgtccgaaacggtctaccccgg

SEQ ID NO: 315308 - DNA, 553 bp, Homo sapiens
  misc_feature: GZ8MTXP02GD137.45.79.H02.1.454.CMB.2.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (415)..(415): a, c, t, g, unknown or other
  misc_feature (415)..(415): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctgtacaangcaccagacaaacgccccaaatcatgtattangaggcagtacgcgcctcgtaggttctaatcgtcttctcgtgctacagtctggcaacgacggcctcctgacaatctacgtggctcgagctgagacgaggtctagattatactgctgctcattangacgtaggtagttagttacgtttgggtcggttacgggcgggtaacggggacctaaacggtcgtacggtaacccgttaccgtacggtaccgaacggacccgaacgggtccctccggcccccgtacgggtccttaacccg

SEQ ID NO: 315309 - DNA, 507 bp, Homo sapiens
  misc_feature: GZ8MTXP02HZIOH.45.79.H02.1.454.CMB.2.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatactgtctctgtaccacagcacccaggcaaagccccaaactcatgatttangaggcagtaagcggcctgaggggtttctaatcgtcttcctctggctccaagtctggctaacacggccctcctgacaatctctggcctcgagctgaggacgaggctgattattactgctgctcatatgcaggtagtagttacgtttggtgttcggcggaggtaccaaagctcgaccgtctaggtcaacgcccaaggctcgccccgtcggtcaccg

SEQ ID NO: 315310 - DNA, 522 bp, Homo sapiens
  misc_feature: GZ8MTXP02HB1C4.45.79.H02.1.454.CMB.2.raw
  modified_base (318)..(318): a, c, t, g, unknown or other
  misc_feature (318)..(318): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagccccaaactcatgatttatgaggcagtaagcggccctnaggggtttctaatcgcttcctctggctccaagtctggcaacacggcctcctgacaatctctggctcagctgagcgaggctgattatactgctgctcatatgctaggtagtagttactttgggtcgttcgggcggtaggggaccaaaggctcggacccgtcctagggtccaagtcccaaagggtctcgcccccgtggtcctaccg

SEQ ID NO: 315311 - DNA, 516 bp, Homo sapiens
  misc_feature: GZ8MTXP02HBRT7.45.79.H02.1.454.CMB.2.raw
  modified_base (224)..(224): a, c, t, g, unknown or other
  misc_feature (224)..(224): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataacttgtctctggtacaacagcacccaggcaaagccccaaactcatgattatgaggcagtaagcgcctctaggggttctaatcgcttcctctggctccagtactggcacacggcctcctgacaatctntgggcctccaggctgaggacgaggctgattattacgngctgtctanatatgcgtagtagtagttagttagtgtcggtacggacggacgacgacgtacgtacgtacgtacgtacgaacgacgacgacgtccgtcccgtccgtcgtcg

SEQ ID NO: 315312 - DNA, 586 bp, Homo sapiens
  misc_feature: GZ8MTXP02FXDHK.45.79.H02.1.454.CMB.2.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggacaaagcccccaaaatcatgatttangaggcagtaagcgcctcgagggtttcaatcgcttcctctgctccaagtctggcaacaccggtcctccctagacaatctcgtggcctcgaggctgaggacgaggctgattattactgctgctacattatgacgtaggtagtaagttcgtttgggtggttccgggacgggtacggggaaccctaaagggtccgttacggtaccccgttaccgtaacggttaccgtaacggttacccgaaacgggtcccgttacccggtaccccccgttacgggtcccttaaccccg

SEQ ID NO: 315313 - DNA, 490 bp, Homo sapiens
  misc_feature: GZ8MTXP02GV7DZ.45.79.H02.1.454.CMB.2.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (474)..(474): a, c, t, g, unknown or other
  misc_feature (474)..(474): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatgttgggattataacttgtctctgtacaacngcaccagcaaagccccaaatcatgatttangaggcagtaagcgcctgagggtttcaatcgtcttctctgctcaagtctggccaacacggcctccctgacaatctctggctccgagctgaggacgaggctgattatactgctgctcagtatgcaggtagtagtacttggtgtcgcggaggacaagctacgaccgtctggtcaacgccaaggcncgccccgtggactacc

SEQ ID NO: 315314 - DNA, 580 bp, Homo sapiens
  misc_feature: GZ8MTXP02IVCYO.45.79.H02.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaaactcatcatttangatgtacaataaatcggccctcaaggggtttcnatccgcttctctgctccaagtctggacaatacgccctcctgaccatctctggctcagctgaagcgaggctgattattactgnagcaacattatatttagtagtttccaacgttcgggtaactttcgggacgggtaggggaaccctaaagggttacgtaacccgttaccgtaacggggttaccaacggacccccgtaaaaggggccctttaccggaccccccgtttcggggtaaccgttaccccg

SEQ ID NO: 315315 - DNA, 530 bp, Homo sapiens
  misc_feature: GZ8MTXP02HP9FA.45.79.H02.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaanagcaccaggcaaagccccaaatcatgatttangaggcagtaagcggccctnagggtttctaatcgcttccnctgctcaagtcngcaacacggcctcctgacaatctactggctcaggctgaggacgaggctgacttattactgctgctcatatgcaggttagtagttctttgggtgttcgggacggaggggaccaacggcgttacgaccgtaccgtacgggtcaacggcccgaaaggtccctcgtcccccgtcggtacctacccg

SEQ ID NO: 315316 - DNA, 492 bp, Homo sapiens
  misc_feature: GZ8MTXP02FQ7MP.45.79.H02.1.454.CMB.2.raw
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (440)..(440): a, c, t, g, unknown or other
  misc_feature (440)..(440): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattanaaccttgtctctggtaccaanagcacccaggcaaacgcccccaaatcatgatttangaggcagtaagcgcctgagggtttcaatcgcttcctctgctcaagtctggcaacacggcctccctgacaatctctggctccgagctgagcgagctgattatacngctgctcatatgcaggtatagtacttggtagttcggnggaggacagctgaccgtcaggtcaacgcccaaggcctcgcccctcggtactc

SEQ ID NO: 315317 - DNA, 517 bp, Homo sapiens
  misc_feature: GZ8MTXP02H8HLT.45.79.H02.1.454.CMB.2.raw
  modified_base (424)..(424): a, c, t, g, unknown or other
  misc_feature (424)..(424): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccatctcctgcactggaaccagcagtgatggttgggattataaccttgtctcctggtaccaacagcacccaggcaaacgccccaaactcatgtattatggggcagtaagcggccctgagggttctaatcgcttctcctggctccaagtctggcacacgcctcctgacaatctcgtcggctaccgagcgtagaggacgaggctgacttatactgctgctcatangcaggtagtagttacgttggtagttcggcggaggaccaagctcgaccgtcgtacgtcgacgccgaaggcctccgcccctcggtccacttcccg

SEQ ID NO: 315318 - DNA, 509 bp, Homo sapiens
  misc_feature: GZ8MTXP02FZ991.45.79.H02.1.454.CMB.2.raw
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggattataaccttgtctcctggtaccaacagcacccaggcaaagcccccaaactcatgatttatgaggcagtaagcggccctgaggggtttctaatcgcttcctctggctccaagtcctggcaacacggcctccctgacaatctctgggctcaggctgagcgagctgattatactgctgctcatatgcaggtagtagttacttggtgttcggcggtagggaccaaaggctagaccgtcctaggtcaagcccaagctcgcccctcggctaccg

SEQ ID NO: 315319 - DNA, 570 bp, Homo sapiens
  misc_feature: GZ8MTXP02HKNAD.45.79.H02.1.454.CMB.2.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattatacttgtctctgtaccangcaccaggcaaacgccccaaactcatgatttangaggcagtaagcggcctcgtaggggtttctaatcgtcttcctctgctcaagtctggcaacacggcctccctgacaatctctggctccgaggctgaggcgagctgattatactgtctgctcatatgacgtaggttagttagttacgttttgggtcgtttccgggacggggtacggtaccgaaacggtcgttacggaacccgttccgttaacggttacgaaccggtaccccgaaacgggtcccgtaccgtccccccggttacggtacccttaacccg

SEQ ID NO: 315320 - DNA, 558 bp, Homo sapiens
  misc_feature: GZ8MTXP02I1WEE.45.79.H02.1.454.CMB.2.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggggattataacttgtctcctggtaccaacngcacccaggcaaacgcccccaaaatcatgatttangaggcagtaagcgcctgagggtttctaatcgcttcctctgctacagtctgcaacncgcctccngacatctcgnggctccgagctgagtacgagtctagattacttacgtgcttgctacgatagtcgcgtaagggttagttacgttacgtttgggtcgttcggggacggtacgggaccaacggtcgtacggtacccgttccgttaggccaacgtcccgaaacgggtccttaccgcccccgttggtacccttacccg

SEQ ID NO: 315321 - DNA, 525 bp, Homo sapiens
  misc_feature: GZ8MTXP02ILI89.45.79.H02.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatgttgggattataaccttgtctctggtaccaacagcacccaggcaaagcccccaaactcatgatttangaggcagtagcgcctgagggttctatcgtcttcctctgctcaagtctgcacncggcctcctgacatctgtggctcagctgaggacgaggctgatattactgctgctcatatgcaggtagtagttactttggtgttcggcgggagggaccaaaggtcgtacgacccgttaccgtaggtaccaacggccccgaaggtccctacggccccccgttggtaccctaccg

SEQ ID NO: 315322 - DNA, 572 bp, Homo sapiens
  misc_feature: GZ8MTXP02G7I1U.45.79.H02.1.454.CMB.2.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccagcagtgatgttggattataactgtctcctggtaccaacagcaccaggacaaacgccccaaatcatgattatgaggcagtaagcggcctcgaggggtttctaatcgcttcctctggctcaagtctcggcaacacggccctcccgtagaacaaacttcgtctcgggccttacccgaggcctaggacgggaacgacggcgtaggaatttagttaacctggtctcggtctctaatagtgcgaaggttagttagttacgtttgggtcgttcggggcggacgggacctaaacggcgtacgacccgttacgtaagtcgaacgcccgaaaggcctccggccccctcggtacctcccg

SEQ ID NO: 315323 - DNA, 510 bp, Homo sapiens
  misc_feature: GZ8MTXP02JXFIS.45.79.H02.1.454.CMB.2.raw
  modified_base (318)..(318): a, c, t, g, unknown or other
  misc_feature (318)..(318): n is a, c, g, or t
  modified_base (396)..(396): a, c, t, g, unknown or other
  misc_feature (396)..(396): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgaggcagtaagcgcctnagggtttctaatcgcttcctctgctccaagtctggcaacacggcctccctgacaatctctgggctcaggctgaggcgngctgattatactgctgctcatatgctaggtagtagttactttgggtgttcgggcgggaggtaccaaggtcgtgacccgtctaggtcaacgccaaggcctcgccccctggctacg

SEQ ID NO: 315324 - DNA, 543 bp, Homo sapiens
  misc_feature: GZ8MTXP02HDJPJ.45.79.H02.1.454.CMB.2.raw
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaacagcacccaggcaaagcccccaaactcatgatttatgaggcagtaagcggcctgacgggtttctaatcgcttcctctgctcagtctggcacacggcctcctgacatctcgtgggctccaggctgaggacgaggctgattattactgctgctcattatgcgaggtagtagttacgtttggtgtttcggacggtagggacccaaggtccgtacggaccgtaccgtaacgggtccaacggaccccgaagggtcccgtcggccccccgttcgggtacctacccg

SEQ ID NO: 315325 - DNA, 534 bp, Homo sapiens
  misc_feature: GZ8MTXP02IHQ0A.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (372)..(372): a, c, t, g, unknown or other
  misc_feature (372)..(372): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattataacttgtctctgtaccaangcaccagcaaacgcccccaaactcatgatttatgaggcagtaagcggccctgaggggtttctaatcgtcttcctctggctcaagtctggcacacgcctccctgacatctntggctcaggctagaggacgagctagattattactgactgctcatatgctaggtagttagttacgtttgggtgttcgggacggtagggaccaaggtcgtacggtaccgtaccgtaggtcgaacggaccccgaaggtccctcggtcccccgttcggtcctaccg

SEQ ID NO: 315326 - DNA, 536 bp, Homo sapiens
  misc_feature: GZ8MTXP02IJZPU.45.79.H02.1.454.CMB.2.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccatctcctgcactggaaccngcagtgatgtggattatactgtctcngtaccanagcaccagcaaacgccccaaatcatgtattatgaggnagtaagcgccctgtagggttctaatcgtcttcctctggctcaagtctggcaacacggtccctccctgacaaatcctcgtcgggacctccgaggtcctaggaggacgaggctagtattattactgcttgtcctnatatgctaggtagtagttacgttggtgtcgggtacggtagggacctaagtctacggtaccgtcgtaaggtcaacggcccaaggccgtcgcccccgtcggtacctccg

SEQ ID NO: 315327 - DNA, 518 bp, Homo sapiens
  misc_feature: GZ8MTXP02JH0OO.45.79.H02.1.454.CMB.2.raw
  modified_base (259)..(259): a, c, t, g, unknown or other
  misc_feature (259)..(259): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatactgtctctgtacacngcaccagcaaacgccccaaactcatgatttatgaggcagtaagcggcctctagggtttctaatcgcttctctgctcagtctgcaacacggcctcctgacaatctctgggctccgaggctgagacgaggctgattattactgctgtctcatatgacgaggtagttagttacgtttggtgttcggcgggtaggaccaaaggtctacggtaccgtccgtaggtccaacggcccgaacggcctccgccccctcggtactaccg

SEQ ID NO: 315328 - DNA, 540 bp, Homo sapiens
  misc_feature: GZ8MTXP02JLJAZ.45.79.H02.1.454.CMB.2.raw
  modified_base (225)..(225): a, c, t, g, unknown or other
  misc_feature (225)..(225): n is a, c, g, or t
  modified_base (412)..(412): a, c, t, g, unknown or other
  misc_feature (412)..(412): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaacagcacccaggcaaacgccccaaactcatgatttatgaggcagtaagcggccctcgaggggtttctaatcgtcttcctctggctccaagtctggcaacacggcctccctgacaatctctggctccaggctgagacgagctgattattangctgctcatatgctaggtagtagttacgtttgggtgttcgggacggaggggacccaaggcgtacgaaccgtccgtaacggtccgaacgcccgaaacggtcctccggtacccccgtcggttcctacccg

SEQ ID NO: 315329 - DNA, 523 bp, Homo sapiens
  misc_feature: GZ8MTXP02J2FNG.45.79.H02.1.454.CMB.2.raw
  modified_base (225)..(225): a, c, t, g, unknown or other
  misc_feature (225)..(225): n is a, c, g, or t
  modified_base (376)..(376): a, c, t, g, unknown or other
  misc_feature (376)..(376): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaatcatgatttatgaggcagtaagcggccctcgaggggtttctaatcgcttcctctggctcaagtctggcacacggcctcctgacatcnctgggctccaggctgaggcgaggctgattatactgctgctnatatgcgtaggtagtagttacgtttggtcgttcggcggagggaccaaggtctacggaccgtccgtaggtacaacgcccgaaggcttccgccccctcggtctacccg

SEQ ID NO: 315330 - DNA, 505 bp, Homo sapiens
  misc_feature: GZ8MTXP02FTQQI.45.79.H02.1.454.CMB.2.raw
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagccccaaactcatgatttatgaggcagtaagcggccctcgaggggtttctaatcgcttcctctgctcaagtctggcaacacggcctccctgacatctctgggctccagctgagacgaggctgattatacngctgctcatatgcaggtagtagtactttggtgttcggcggtaggaccaagctagaccgtctaggtcaagcccaaggcctcgcccctcggtctacc

SEQ ID NO: 315331 - DNA, 528 bp, Homo sapiens
  misc_feature: GZ8MTXP02JGLRB.45.79.H02.1.454.CMB.2.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaacgcccccaaatcatgatttangaggcagtaagcggccctgaggggtttctaatcgtcttcctctgctcagtctggcaacacggcctcctgacaactctctgggcctccgaggctgagacgaggctgattattactgctgctcatangcaggtagtagtacgtttggtgttcgggcggtagggacctaaaggctacggaccgtccgtaggtccaacggcccgaagggcctcgcccccgttcggctaccg

SEQ ID NO: 315332 - DNA, 571 bp, Homo sapiens
  misc_feature: GZ8MTXP02JODNU.45.79.H02.1.454.CMB.2.raw
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctgtaccaacagcacccaggcaaacgcccccaaactcatgatttangaggcagtaagcgcctgaggggtttctaatcgtcttcctctgctccaagtctggcaacacggccctcctgacaatctcgtcgggctccgaggctggagacgagctgattatactgctgctcatatgacgtaggttagttagttacgtttgggtacggtttcgggacgggtaaggggacccaaaggtccgtacggtaacccgttccgttaaacggtccgaacggtaccccgaacgggtccctcccggtcccccgttcgggtacctaccccg

SEQ ID NO: 315333 - DNA, 513 bp, Homo sapiens
  misc_feature: GZ8MTXP02HU9MY.45.79.H02.1.454.CMB.2.raw
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatactgtctctgtacangcaccaggcaaagccccaaatcatgatttangaggcagtaagcggcctcgagggttctaatcgtcttcctctgctcagtctggcaacacgcctccctgacatctctggctcgagctgaggacgaggctgattattactgctgctcatatgcaggttagtagttactttgggtgttcgggcggaggaccaaagcgttacgaccgtccgtaggtcaacggtcccgaaaggtcctaccggtccccctggtacctaccg

SEQ ID NO: 315334 - DNA, 567 bp, Homo sapiens
  misc_feature: GZ8MTXP02FX68L.45.79.H02.1.454.CMB.2.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccanagtgatggttgggtagttttagtttgtctctggtaccaacaacaccccggcaacgccccaaataatcatttanaggacactaagcggccgtggggtttcaagtcgcttctctggctcaagtctcggcacacgcctcctgacatctctggctcgaggctgagcgaggctgattatactgctgctacattactgcgtaggttagttagttacgtttgggtcgttcgggacggacgggtacaaggcgtacggaccgtccgtagggtccacggtacccaaacggtcctccgcccccgttcggtcctaccttccgttcccgttacccccacccttccctactccgg

SEQ ID NO: 315335 - DNA, 700 bp, Homo sapiens
  misc_feature: GZ8MTXP02HXYVW.45.79.H02.1.454.CMB.2.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactggaaccngcagtgatgtggattatactgtctctgacangcaccagcaaacgcccaaatcatgtattangaggcagtacgcgcctgtaggttctaatcgtcttcctcgtgcctacgtaagttcctgggaccaaaccgccggtacccctacccgtagaacctaaacgttccctacgttcgggcccttcccgaagggtccgtagggaacggaccggtaaggtccgttaggtaatttaacgttaccgttcggtaccttggtaccttacgtaattaagtccggtaacggtaaggggtttaacggtttaaggtttaaccgtttttgggggtcggtttaccggggacggggttaaacggggtaacccgtaaacggtcccggtaccggttaaacccgggttcccgtttaaagggtcccgtaaaccggtaacccccggaacggggtaccccgttacccggtacccccccggtttcgggtaacccttcccccgg

SEQ ID NO: 315336 - DNA, 532 bp, Homo sapiens
  misc_feature: GZ8MTXP02JPNSB.45.79.H02.1.454.CMB.2.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgtggattatacttgtctctgtacangcacccaggacaaacgccccaaactcatgatttangaggcagtaacgcggccctgtagggttctaatcgtcttctctgctcagtctggcaacacggccctccctagacaatcctctgggccctccgaggctggacggacgaggcttagacttattactgctgctanatangacgtaggttagtagttcgttggtcggtcgggacggacggacacgtcgtacgaccgtacgtacggtacaacgaccgacggcctaccgcccgttcggtactaccg

SEQ ID NO: 315337 - DNA, 528 bp, Homo sapiens
  misc_feature: GZ8MTXP02IMIU7.45.79.H02.1.454.CMB.2.raw
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattataaccttgtctctggtaccaangcaccaggcaaagcccccaaatcatgatttangaggcagtaagcggcctgaggggtttctaatcgcttcctctgctcaagtctggcaacncggcctcctgacaatctctgggctccgaggctgaggcgaggctgattattactgctgctcatatgactagggttagtaaggttctttgggtgtttcgggacggtaaggggacccaaaggcttacggaccgttcctagggtcaacggcccaaggcctcgcccccttggtcctaccg

SEQ ID NO: 315338 - DNA, 553 bp, Homo sapiens
  misc_feature: GZ8MTXP02GAXBE.45.79.H02.1.454.CMB.2.raw
  modified_base (301)..(301): a, c, t, g, unknown or other
  misc_feature (301)..(301): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcaccaggacaaacgccccaaatcatgatttangaggcagtaacgcggcctcgagggtttctaatcgcttcctctggctaccaagtctggcaacgacggcctcctgacaatctctggcctcaggctgagacgaggctgattatacngctgctcatatgcgtaggttacgtagttacgtttgggtcgttcgggacggtacgggacctaaacggtcgtacggtacccgttcgtagggtaccaacggtaccccaaggtccgtaccgcccccgttcggtaccttacccg

SEQ ID NO: 315339 - DNA, 519 bp, Homo sapiens
  misc_feature: GZ8MTXP02GHYUB.45.79.H02.1.454.CMB.2.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtacaacngcacccaggcaaagcccccaaatcatgatttatgagggcagtaagcggccctcaggggtttctaatcgcttcctctggctccaagtctgggcaacacggcctccctgacatctctggctcaggctgaggacgaggctagattattacgtgctgctcatatgactaggtagtagttactttggtgtttcggcgggacggtacacgctacgaccgtcctaaggtcaacgcccaaggctacgccctacggtctaccg

SEQ ID NO: 315340 - DNA, 528 bp, Homo sapiens
  misc_feature: GZ8MTXP02GS8P3.45.79.H02.1.454.CMB.2.raw
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatactgtctcngtacangcaccagcaaagccccaaatcatgatttangaggcagtaagcgcctgagggtttctatcgtcttcctctgctccagtctggcaacacggcctcccgtgacaatcctctggcctcaggctgagacgagctgattattacngctgctcatatgcaaggtagtagttacgtttgggtgtttacggcggtaaggaccaaaggtctacggtacccgtcccgttaaggccaaggcccccaaaggtccctcgccccccgttcgggtacctaccccg

SEQ ID NO: 315341 - DNA, 561 bp, Homo sapiens
  misc_feature: GZ8MTXP02G2GLZ.45.79.H02.1.454.CMB.2.raw
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (435)..(435): a, c, t, g, unknown or other
  misc_feature (435)..(435): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactcttctcactcaggacacagggtcctgggcccagtctgccctgactcagcctgcctccgtgtctgggtctcctggacagtcgatcaccatctcctgcactggaaccngcagtgatgttgggattataacttgtctctggtaccaacagcacccaggcaaacgcccccaaatcatgtattangaggcagtaagcgtccctgaggggtttctaatcgtcttcctctggctccgaagtctggcaacgacggcctccctgacatctctgggcctcgaggctggaggacgaggtctgattattactgctgtctacattacngacgaggttagtagttacgttttgggtcgttacggggaccggagggtaacccgaagtcgtacggacccgttcgttaggccgaacggacccgaacggtccctccgtcccccgtcggtacctaacccg

SEQ ID NO: 315342 - DNA, 544 bp, Homo sapiens
  misc_feature: GZ8MTXP02F62U3.45.79.H02.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaacgcccccaaatcatgatttangaggcagtaagcgcctgagggtttcaatcgcttcctctggctccaagtctggcaacacggcctccctgacaatctctgggcctccgaggctgaggacgaggctgtacttattactgctgctcatatgctaggtagttaagtcgtttggtgttcgggacggaggggtaccaaggccgtacgtacccgtaccgttaggtaccaacggcccgtaaaggccctcggtcccccttcggtacctcccg

SEQ ID NO: 315343 - DNA, 576 bp, Homo sapiens
  misc_feature: GZ8MTXP02JIU1L.45.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaangcacccaggcaaacgcccccaaactcatgatttangaggcagtaagcggcctgagggtttctaatcgtcttctctggctccaagtctggcaacacggcctcctgacatctctggctccgaggctgagcgaggctgattattacngtcgtnctcatangacgtaggttaagtacgttacgtttgggtcgttcgggacgggtacggggaacctaaggtcgtaacggtacccgttaccggtacggttacccgaacggtccccgaaaacgggtcccgttaccggtaccccccgttaccgggtcctttaaccccgg

SEQ ID NO: 315344 - DNA, 513 bp, Homo sapiens
  misc_feature: GZ8MTXP02JA5DE.45.79.H02.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattanaaccttgtctcctggtaccaacngcacccaggcaaagccccaaatcatgatttangaggcagtaancggcctcagggtttcaatcgcttctctggctccaagtcctggccaacacggcctccctgacaatctctgggctccaggctgagacaggctgattatacgngctgctcagtactgcaggtagtagtacgtttggtgttcggacggtaggaccaaggcctgaccgtccgtaggtcaaggcccaaggtcctcgccccctggtacaccg

SEQ ID NO: 315345 - DNA, 586 bp, Homo sapiens
  misc_feature: GZ8MTXP02GWOK3.45.79.H02.1.454.CMB.2.raw
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggattataaccttgtctcctggtaccaacagcacccaggaccaaacgcccccaaactcatgatttanggaggcagtaagccggcctcgtaggggtttctaatcgtcttcctcgtggctccaagtctggcaacgacggccctcctgacaatctcgtggctcgaggctgaggacgaggctagtattattactgctgtctacgatagtgacgaggttagttaggttacgtttgggtcggttacgggacgggaagggtacccgaaaggtccgtacggtacccggttaccgttaacgggtccaacggaccccgaaacggtccgtcccggtccccccgttggtaccctcccg

SEQ ID NO: 315346 - DNA, 542 bp, Homo sapiens
  misc_feature: GZ8MTXP02IG7X5.45.79.H02.1.454.CMB.2.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattgttgggattataacttgtctctggtaccaanagcacccaggcaaagcccccaaatcatgatttangaggcagtaagcggcctgagggtttctatcgcttctctggctcagtctgcacncgcctcctgacatctntggctcagctgagcgagctgattattacngctgctcatatgactaggttagttaagttacgtttgggtcggtttcgggacgggtacgggaaccaaggtaccgtcggtacccgttaccgttaggtaccaacggaccccgaaaggcccttccggtccccccgttggtaccctcccg

SEQ ID NO: 315347 - DNA, 540 bp, Homo sapiens
  misc_feature: GZ8MTXP02HGFO3.45.79.H02.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaactcatgatttangaggcagtaagcgccctnaggggtttctaatcgcttcctctgctcagtctggcaacacggcctcctgacatcnctggctccgagctgagacgaggctgattatacngctgctcatatgctaggtagtagttacgtttggtgttcgggtacggtagggaccaaacggtcgtacggtacccgtaccgtaggttaccaaggccccaaagggtccctcggcccccgtcgggtacctacccgg

SEQ ID NO: 315348 - DNA, 587 bp, Homo sapiens
  misc_feature: GZ8MTXP02G0LFE.45.79.H02.1.454.CMB.2.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccngcagtgatggttgggattataacttgtctcctggtaccaacagcacccaggaccaaacgcccccaaaatcatgatttangaggcagtaagccgtcctgagggtttcaatcgtcttcctcgtgtctaccaagtccgtgggaccaaaccgaccggccctcccctagaaccaaacttcctacgtcgggcttacccgaggtccgtaggacgggacggaaggtccgtagatttaacttaacgtcgtctcgtctctatatgactaggttagtagttacgtttggtggtcggacggagggtaccaaagcgtacggtaccgtctacggtcaacggcccaaacggtcctccggcccccttcggtactacccg

SEQ ID NO: 315349 - DNA, 526 bp, Homo sapiens
  misc_feature: GZ8MTXP02JHDY7.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaacgcccccaaactcatgatttatgaggcagtaagccggccctcgaggggtttctaatcgcttcctctggctcaagtctggcaacacggcctccctgacaatctctggctcaggctgagcgaggctgattatactgctgctcatatgctaggtagtagttacgttggtgttcgggacggaggggtacccaaaggtctacggacccgttcgtaggtcaacgcccgaaggcctcgccccctcggtctaccg

SEQ ID NO: 315350 - DNA, 566 bp, Homo sapiens
  misc_feature: GZ8MTXP02ICRW4.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattataaccttgtctctgtacaangcaccagcaaacgccccaaatcatgatttatgaggcagtaacgcggcctgagggtttctaatcgtcttctctgctcagtctgcacacgcctcctgacatctgtggctccgaggctagacggacgaggctgattattactgctgctacgattactgactagggttagttaggtttacgtttggggtacgtttcggggcggggtaacgggaccgtaaacggccgttacggacccggttcccgtaaaggttccgaacggtaccccgaagggtcccgtacccggtccccccgttacggtcctaccccg

SEQ ID NO: 315351 - DNA, 538 bp, Homo sapiens
  misc_feature: GZ8MTXP02I5SCX.45.79.H02.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctgtaccangcacccaggcaaagcccccaaatcatgatttangaggcagtaagcgggccctgaggggtttctaatcgcttcctctggctccaagtctgcaacncggcctccngacatctcnggctcgagctgagcgagctgattnttangctgctcatatgactagggttagtacgttacgttttgggngttcgggacggagggtaccaaggtccgtacgggtaccgttccgtagggtacaacggacccgtaagggtccctcggccccccttggggtcctacccg

SEQ ID NO: 315352 - DNA, 643 bp, Homo sapiens
  misc_feature: GZ8MTXP02HQB57.45.79.H02.1.454.CMB.2.raw
  modified_base (259)..(259): a, c, t, g, unknown or other
  misc_feature (259)..(259): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggattataactgctctgaccaanagcaccagacaaacgcccccaaactcatgtatttatggaggcaagtaagcggccctagaggggtttctaaatcgtcttccctctggctaccgaagtcctagggccaaacgacggcccttcccctagaaccaaattcctcgtcgggccttacgaacggcctagaggaccggaagggtcctaagtatttaagttaactcggtctcgtactactattaattcgataagggtaagttagttaacgttttggggtggtttacggggacgggtacgggggtaaaccaaacggtccggtacgtacccggtacccgtttaagggtaccgtaaacggaccccgtaaaacgggcccttacccggacccccccgttcgggttaccttaaaccccg

SEQ ID NO: 315353 - DNA, 657 bp, Homo sapiens
  misc_feature: GZ8MTXP02HSAWD.45.79.H02.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccagcagtgattggttggattactacttgtctctgaccaacngcaccagacaaacgccccaaatcatgtatttagnggaggacaggtaacgccgtcctgtacgggtttctaagtcgtcttcctcgtcggtcctacgtaagttccgaggacctaaaccgaccggcccttacccccgtagaacctactccgtccgtcgggtccctaccgacgggtccgttaggaacggggaccgtaggtcgtagtaactttacgtttacgtcgtcttacgtcctactaaattagtgacggttaagggttaaggttagtttacggttttggggtcggttcgggggtacggtaaacgggaccgtaaaggtccgttacggtacccgttacgtacgggtacaacggtacccggaacggtcccgaccgtcccccgttacggtaccttccccg

SEQ ID NO: 315354 - DNA, 568 bp, Homo sapiens
  misc_feature: GZ8MTXP02GW9HJ.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataactgtctctgtacaangcaccagacaaacgccccaaatcatgatttangaggcagtaagcgcctgtagggtttcaagtcgtcttcctctggctccaagtctaggcaacacggtcctccctgacaatctcgtggcctccgaggctggaaggacgaggtctagtattattactgctgctcatatcgagtaggttagtagttacgtttgggtggttcgggacgggtaacgggacctaaaggtccgtacggtacccgttaccgtacgggttaccaacggaccccgtaaaggtcccgtacccggcccccgttccggtaccttacccg

SEQ ID NO: 315355 - DNA, 582 bp, Homo sapiens
  misc_feature: GZ8MTXP02GDB2R.45.79.H02.1.454.CMB.2.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcaccaggcaaacgcccccaaatcatgatttangaggcagtaagcgcctagtagggtttcaatcgcttcctctgctcaagtctggcaacacggcctccctgaacatctcgtggctcagctgagcgaggctgtattattacgtgccttgctactaatagtagacgtaaggttagttaaagtttcggtttgggtcgggtttaccggggacgggttaacgggggacctaaacgggcgttacggtaccccgtacgttacgggtaccaacggtacccgaacgggtcctcccgtacccccggttcggtacccttaaccg

SEQ ID NO: 315356 - DNA, 541 bp, Homo sapiens
  misc_feature: GZ8MTXP02GKKA4.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaacagcacccaggcaaacgcccccaaatcatgatttatgagggcagtaagcggccctgtaggggtttctaatcgcttcctctggctccaagtctggcaacacggccctccctgacaatctctgggctccaggctgaggacgagctgattattactgctgctcatatgctagggttagtagttactttgggtgttcgggacggtagggtaccaaggcgtacggacccgtccgtaggtacaacggacccgacggtccgtccgcccccgtcggtcctacccg

SEQ ID NO: 315357 - DNA, 564 bp, Homo sapiens
  misc_feature: GZ8MTXP02GN40F.45.79.H02.1.454.CMB.2.raw
  modified_base (267)..(267): a, c, t, g, unknown or other
  misc_feature (267)..(267): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacngcacccaggcaaacgccccaaatcatgatttatgaggcagtaagcgcctgagggtttcaatcgcttcctctgctccaagtctggcaacacggcctcctgacaatctctgggctccgaggctgacggacgagggctgattattacngctgcctanatatcgngtaaggttagtagttactttggggtacgttcgggacgggtaacgggtaaccaaggtccgtacgggacccgttacccgtaaagggtccaaacggtccccgaaagggtcctacccggcccccgttcggtacctacccg

SEQ ID NO: 315358 - DNA, 560 bp, Homo sapiens
  misc_feature: GZ8MTXP02IVRYD.45.79.H02.1.454.CMB.2.raw
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaagggggggtcacgagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggcaaaacgcccccaaactcatgatttatgaggcagtagcgcctnagggtttctaatcgtcttcctctgctccaagtcctggcaacacgcctcctgacatctcgtggctcgagctgagacgagctagattatactgactgctcatangcgtaggttagtagttacgtttggtgttcgggacgggtagggacccgaaaggtccgtacggtacccggtccgttaacggtccaacgggtcccaaacgggtcccgtaccgtccccccggttacggtcccttaccccgg

SEQ ID NO: 315359 - DNA, 552 bp, Homo sapiens
  misc_feature: GZ8MTXP02JSYQ5.45.79.H02.1.454.CMB.2.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattatactgctcngtacangcaccagacaaacgccccaaatcatgtatttangaggcagtagccgcctgagggtttctaatcgtcttctctggctccaagtcgtggcaacncggaccttccgngactaactctcgtggacctcgaggctagaacgcgaggtctagattatactgacagctanattattaagttgttcgttacgtacgttcgggtattacgggacggtacggtaccgtaaggttcgaccgttacgtacggtaccacgtacccgaaggtcctaccggccccctggaccctacctcgtttaccccg

SEQ ID NO: 315360 - DNA, 574 bp, Homo sapiens
  misc_feature: GZ8MTXP02J3L1U.45.79.H02.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctcctgtaccaacagcacccagaccaaacgccccaaactcatgatttangaggcagtacgcgcctcgaggggttctaatcgcttcctctggctacaagtctggccaacaccggtccctccgtgactaactcctacgtcgggcctccgagggtctagacgggacgagggcttaggtactttactacgtcgtctcgctacattagtgacgtaggtagtagttacgtttgggtcggttcggcgggacggacaacggcgttacggaccgtaccgtacggtaccgaacgacccgaacggcctcccggacccccgtcggtcctacccg

SEQ ID NO: 315361 - DNA, 527 bp, Homo sapiens
  misc_feature: GZ8MTXP02GP2UY.45.79.H02.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaatcatgatttangaggcagtaagcggcctcgagggtttcaatcgcttcctctgctcaagtctggcaacacggcctcctgacaatctctgggcctcaggctgagacgaggctgattatactgctgctacatatcgagtaggtagtagttatttgggtgttcgggacggtacggaccaagcgtacgacccgttcgtaggtcaacgaccccgaaggtccgtccgcccccgtcggtctacccg

SEQ ID NO: 315362 - DNA, 537 bp, Homo sapiens
  misc_feature: GZ8MTXP02H9NL3.45.79.H02.1.454.CMB.2.raw
  modified_base (225)..(225): a, c, t, g, unknown or other
  misc_feature (225)..(225): n is a, c, g, or t
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattatactgtctctgtacacagcaccaggcaaacgccccaaatcatgatttatgaggcagtaagcggcctgagggttctgactcgccttctcgtcgctccaagttctggccaacacggccctccctgaccatcctcgngggcctccaggctggaggacgtaggcttgattattactgctagcttcgattacncgacacgcacgctacgtacgtacttacgttagtacgttacgggacgggacggaaccgaacgtcgtaacgtacccgtacgtacggaccgaccggaccgaacggtcccg

SEQ ID NO: 315363 - DNA, 505 bp, Homo sapiens
  misc_feature: GZ8MTXP02GQ71J.45.79.H02.1.454.CMB.2.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgtgagttataaccttgtctcctggtaccaacagcacccaggcaaagcccccaaatcatgatttatgaggcagtaagcggccctcaggggtttcaatcgccttctctggctccaagtctggcaacacggcctcctgacatctctggctccaggctgaggacgagctgattatactgctgctcatatgcaggtattagtactttgggtgttcggcggaggtaccaagctcgacccgtcgtaggtcagcccgaaggcctcgcccctggtccc

SEQ ID NO: 315364 - DNA, 531 bp, Homo sapiens
  misc_feature: GZ8MTXP02FOEZC.45.79.H02.1.454.CMB.2.raw
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgccccaaatcatgatttangaggcagtaagcggccctgaggggtttctaatcgcttctctgctcaagtctggcaacacggcctcctgacatcnctggctcagctgagcgagctgattattctgttgctcattatgcgagggaccagcgtagttgggtgttcgggcggacgggaccgtacgggttcgaccgtccgtacggtccgacgcccgtaaacggcctaccgtcccccgtcggtccctacgtttcccg

SEQ ID NO: 315365 - DNA, 562 bp, Homo sapiens
  misc_feature: GZ8MTXP02IUCLC.45.79.H02.1.454.CMB.2.raw
  modified_base (226)..(226): a, c, t, g, unknown or other
  misc_feature (226)..(226): n is a, c, g, or t
  modified_base (264)..(265): a, c, t, g, unknown or other
  misc_feature (264)..(265): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaanncaccagcaaacgccccaaactcatgatttangaggcagtaagcgcctgtagggttctaatcgtcttcctcgtggctaccgaagtcgtcgcaacaccggccctcccgtagacaaactcctcgcggctcccgaggctgaggacgaggctagattatactgtctgctctatagtgtacgaggttagtagttacgtttggtacggttcggacgggagggtaacccaagtccgtacgtacccggtacgtacggtacaacggccccgaaacggtccgtccgtcccccgtcggtaccctacccg

SEQ ID NO: 315366 - DNA, 541 bp, Homo sapiens
  misc_feature: GZ8MTXP02H9TLA.45.79.H02.1.454.CMB.2.raw
  modified_base (293)..(293): a, c, t, g, unknown or other
  misc_feature (293)..(293): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattatactgtctctgtaccacagcaccaggcaaacgccccaaactcatgatttangaggcagtaagcggacctgagggtttctaatcgcttcctctgctcagtctggcaacgacgcctcctgacaatcctcgtcggctccgagctgaggacgaggctagtattatactgctgctactatatgcgtaaggtagtagttacgttgggtacgttcgggtcgggacgggtacaaacgtcgtacggtaacccgtccgttaaggtccaacggcccaaacgggtcctaccgcccccgtcggtacctcccg

SEQ ID NO: 315367 - DNA, 585 bp, Homo sapiens
  misc_feature: GZ8MTXP02I5TQR.45.79.H02.1.454.CMB.2.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaacgcccccaaactcatgatttangaggcagtaagcgcctgtagggtttctaatcgtcttctctgctccagtctgcacncggcctccngacatctctggctccgaggctgaggcgaggctagattatactgctgctacattagtgacgtaggtagttagttacgtttggggtcgtttcgggacgggtacggggtaaacccaagggtccgttacggaccccgttacccgttaaggggtacccaacgggccccccgtaaaagggggtccccttcccgggtacccccccttggggtacccctttaacccg

SEQ ID NO: 315368 - DNA, 532 bp, Homo sapiens
  misc_feature: GZ8MTXP02I1QIP.45.79.H02.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataccttgtctctgtacaacngcaccaggcaaacgccccaaatcatgatttangaggcagtaagcgccctgagggtttctaatcgcttcctctggctacagtctggcaacacggcctccctgactaatctactgggcctcgaggctgaggcgagctagattatacngctgctcatactgacaggttagtagttacgtttgggtgttcgggacggtagggaccacggtcgtacggtaccgtcgtaggtacaacgacccgtaaggccttaccggcccccttcggtcctaccg

SEQ ID NO: 315369 - DNA, 539 bp, Homo sapiens
  misc_feature: GZ8MTXP02IHULS.45.79.H02.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattataacttgtctctgtaccaanagcacccaggcaaagcccccaaatcatgatttangaggcagtagcgcctgagggttcatcgcttccnctggctccaagtctggcaacncggcctccctgacatcnctggctcagctgaggacgaggctgattattactgctgctcatatgactaggttagtagttacgtttggtcggttcgggacggaggggaccaaaggtccgtacggacccggttaccgtaggtaccaaggcccccgaaaggggtcctaccggtcccccgttcgggtacctacccg

SEQ ID NO: 315370 - DNA, 515 bp, Homo sapiens
  misc_feature: GZ8MTXP02G343Z.45.79.H02.1.454.CMB.2.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggagttataacttgtctcctggtaccaacagcacccaggacaaacgccccaaatcatgatttangaggcagtaagcggccctcgaggggtttctaatcgtcttcctctggctccaagtctgcaacacggcctccctgacaatctctggctcagctgaggcgaggctgattatactgctgctcatatgcaggtagtagttactttgggtgttcggcggagggacaaggtctacgaccgtctaggtcaacgtcccgaaggcctcgccccctcggtctaccg

SEQ ID NO: 315371 - DNA, 518 bp, Homo sapiens
  misc_feature: GZ8MTXP02GSA8F.45.79.H02.1.454.CMB.2.raw
  modified_base (418)..(418): a, c, t, g, unknown or other
  misc_feature (418)..(418): n is a, c, g, or t
tcagacgcgatcgacacgaccggtgctcgatttagtgtcacacgaagggaaagggggtcacaagaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacaccaggcaaagcccccaaactcatcatttatgatgtcaataatcgcctcaggggtttctctatcgcttctcctggctccaatctggcatacggcctcctgaccatctctgggctccgagctgaagacgaggctgtattatactgcctagnacatatattagtgtttaccagtcggtattcggcggacggactaagttgaccgtcctaaggtcagtcccaaggctcgcccctcggtcactctcgttccccg

SEQ ID NO: 315372 - DNA, 523 bp, Homo sapiens
  misc_feature: GZ8MTXP02JLIP0.45.79.H02.1.454.CMB.2.raw
  modified_base (225)..(225): a, c, t, g, unknown or other
  misc_feature (225)..(225): n is a, c, g, or t
  modified_base (318)..(318): a, c, t, g, unknown or other
  misc_feature (318)..(318): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagccccaaactcatgatttatgaggcagtaagcggcctnaggggtttctaatcgcttcctctcggctccaagtctggcaacacggcctccctgacaatctacgtggctcagctgagacgagctgattatactgctgctcatagngcgaggtagtagtactttgggtagttcggcggagggtaccaaggcgtacgaccgtccgtaggtccaagtacccgaaggcctacgcccctcggtctacccg

SEQ ID NO: 315373 - DNA, 650 bp, Homo sapiens
  misc_feature: GZ8MTXP02HLOGI.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataacttgctctgtaccaacngcaccagcaaacgcccccaaatcatgtattatgaggcagtaagcggtcctcgtaggggtttctaatcgcttcctcgtggtctaccaagttctggccaaccgaccggccctcccgtagtacaaattcctacgtcgggccttaccgagggtcctaggaacggacgtagggcttagaagtttacttaacgttcgtacttcgtcttaccgtaattacgtttggaccgttaagggttaacgtttaaggtttaaccgttttgggggttcggtttaccgggacggggtaaacgggtaacccgaaaggtccggttacggtaccccgttccggtaacggttacgaaccgtacccgtaacggtccctccggtaccccccgtcgggttaccctaacccg

SEQ ID NO: 315374 - DNA, 520 bp, Homo sapiens
  misc_feature: GZ8MTXP02G8LGD.45.79.H02.1.454.CMB.2.raw
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcatggaaccngcagtgatgtggattatactgctctgtacangcaccagcaaagccccaaatcatgattangaggcagtaagcgcctgagggttctaatcgtcttcctctggctcaagtctggctaacgacggccctaccgtgacaatctctcggcctccgaggcctgaggacgaggtctagtattattactgctgctcatagtcgagtaggttagtaagttcgtttgggtcgttcggacggacgggtaccaagcgtcgaaccgtcgtacgtcaacgccgaaggtctccgcccctacggtctaccg

SEQ ID NO: 315375 - DNA, 513 bp, Homo sapiens
  misc_feature: GZ8MTXP02JXTTR.45.79.H02.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaacagcacccaggcaaacgcccccaaactcatgatttangaggcagtaagcggcctnagggtttcaatcgcttcctctgctcaagtctggcaacacggcctcctgacaatctcngggctcgnggctgaggacgaggctgattatactgctgctcatangcaggttagtatacgtttggtgttcgggtcgggaggaccgaagtcgtcgaccgtcctaggtcaacgccaacggctcgcccccgtcggtctaccg

SEQ ID NO: 315376 - DNA, 520 bp, Homo sapiens
  misc_feature: GZ8MTXP02JAI9Z.45.79.H02.1.454.CMB.2.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctggacccagtctgccctgactcagcctgcctccgtgtctgggtctcctggacagtcgatcaccatctcctgcactggaaccngcagtgatgtggattataaccttgtctcctggtacaacagcacccaggccaaagcccccaaactcatgatttangaggcagtaagcggccctnacggggtttctaatcgcttcctctggctccaagtctggccaacaccggcctcccgtgacaatctactggctcgagctgagcgagctgtatattactgctgtctcatatgctaggtagtagtactttggtgttcggcgggtaggaccaaggctacgaccgtcgtaggtccaagcccaaggcctacggcccctcggtctacccg

SEQ ID NO: 315377 - DNA, 503 bp, Homo sapiens
  misc_feature: GZ8MTXP02IS89K.45.79.H02.1.454.CMB.2.raw
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcaccaggcaaagcccccaaatcatgatttatgaggcagtaagcggcctnagggtttcaatcgcttctctgctccagtctgcacacgcctccngacatcntggctcagctgagcgaggctgattattactgtctgctcatactgcaggtgtagttacgtttgggtgttcgggacggagggaccaagtctcgaccgtcctaggtccaagacccaggcctcgccccctcggtctaccg

SEQ ID NO: 315378 - DNA, 564 bp, Homo sapiens
  misc_feature: GZ8MTXP02IT5EF.45.79.H02.1.454.CMB.2.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggtgggattataacttgtctctgtacangcaccagacaacgcccccaaacncatgatttatgaggcagtaagccggcctgtaggggtttctaatcgtcttcctctggcctccaagttctacggcaaccgaccggcctccctgactaactctcgtgggcctccgaggctggaggtaccgaggtctagtattagttactgtctgtcctactataagtgacgtaggttacggtaagttcgtttggtggttcgggacggacgggaccaggtctacggtacccgttacgtaggtaccgaacgtccgaacggtctccgccccgtacggtcctaccg

SEQ ID NO: 315379 - DNA, 652 bp, Homo sapiens
  misc_feature: GZ8MTXP02HQC1B.45.79.H02.1.454.CMB.2.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaaggggggtcacaagaggcagcgctctcgggactctccaccatggcctgggctctgctgctcctcactctcctcactcaggacacagggtcctgggcccagtctgccctgactcagcctgcctccgtgtctgggtcctcctggacagtcgatcaccatcctcctgcactggaaacccngcagtgattggttagggattactacttgtctctgtacacacgccaccagacaaaccgaccccaaactcatgtatttagaggaggactaggtaacgccggtaccctcggtagggtttactaacgtcgtcttcctcgtcgtcctacgtagtcgtacggccaaccgtccggtccctcccgtagaactaactccgtcgtcggtcctaccgacggtcgtacggacgggacgtacggtacgtagtacgttattacgtgtcgttcgtcttactactagtacgtacgtaaggttagtttacggtttacgtttacgggtcgggttacggggacgggtacgggtaaccgtacggtcgtacggtaccgtaccgtaacggtacgaaccggtacccgtaacggtccgtacccggtacccccggttacgtacgtcccg

SEQ ID NO: 315380 - DNA, 510 bp, Homo sapiens
  misc_feature: GZ8MTXP02IV60R.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctcctggtaccaacagcacccaggacaaacgccccaaactcatgatttatgaggcagtaagcggcctgagggtttctaatcgtcttcctctgctccagtctgcaacacggcctcctgacaatctctggctccgagctgagacgaggctagattatactgctgctcatatgcaggtagtagtacgttggtgttcggcggaggaccaaggctacgaccgtcgtaggtcaacgcccgaaggcctacgcccctcggtcctaccg

SEQ ID NO: 315381 - DNA, 539 bp, Homo sapiens
  misc_feature: GZ8MTXP02H0PZI.45.79.H02.1.454.CMB.2.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (450)..(450): a, c, t, g, unknown or other
  misc_feature (450)..(450): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcagcagtgatggttggagttataacttgtctctggtaccaacngcaccaggcaaacgccccaaatcatgatttangaggcagtagcggcctgagggtttcaatcgcttctctgctcagtctggcacacgcctccngacatcnctggctcaggctgaggcgagctgattagttactgtctgcctntatatgacgtaggtattaggttacgtttgggtcgtttcgggnggtaacggtaccaaaggcgttacggacccgttaccttagggtaaccgacggtaaccccgagggtcctccggtacccccgttacggtccc

SEQ ID NO: 315382 - DNA, 563 bp, Homo sapiens
  misc_feature: GZ8MTXP02HE1YY.45.79.H02.1.454.CMB.2.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatggttgggattatacttgtctctgtaccaacngcaccaggacaaacgccccaaatcatgattangaggcagtaagcgcctgagggttcaatcgtcttcctcgtgctcagtctggcaacgcggccctcctagacatcctcgtgggcctaccgagctgacggacgaggtctagtattactactgtctgtctanactatcgacgtaggttacgttagttacgtttcgggtcggttcggggacggtaacgggacctaaaggtccgtacggacccgttaccgtacggtaccgaacggacccgaacggtcctcccggccccgttacggtcctacccg

SEQ ID NO: 315383 - DNA, 534 bp, Homo sapiens
  misc_feature: GZ8MTXP02HIB14.45.79.H02.1.454.CMB.2.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattataaccttgtctcctggtaccaacagcacccaggcaaacgccccaaactcatgattatgaggcagtaagcggccctcgaggggtttctaatcgtnttcctctgctcaagtctggcaacacggcctccctgacaatctctggctcgaggctgagacgagctgattacttactgctgctctatatgacgaggttagtagttacgtttggtgttcgggcggagggacaaacgcgtacgaccgttcctaggtcaacgcccgaacggtcctaccgcccccgtacggttccaccg

SEQ ID NO: 315384 - DNA, 514 bp, Homo sapiens
  misc_feature: GZ8MTXP02IUOYP.45.79.H02.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (400)..(400): a, c, t, g, unknown or other
  misc_feature (400)..(400): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccngcagtgatgttgggattataacttgtctctggtaccacagcacccaggcaaagccccaaactcatgatttangaggcagtagcggcctcgnggggttctaatcgctctctgctcaagtctggcaacacggcctcctgacatctctggctccagctgaggcgaggctgattattactgntgctcatatgacaggtagtagttacgtttggtgttcggcggagggaccaaaggtctacggtaccgtcgtaacggtcaacgacccgaaacggctccgcccccgtcggtacctccg

SEQ ID NO: 315385 - DNA, 572 bp, Homo sapiens
  misc_feature: GZ8MTXP02GWL2O.45.79.H02.1.454.CMB.2.raw
  modified_base (226)..(226): a, c, t, g, unknown or other
  misc_feature (226)..(226): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaacgcccccaaactcatgatttatgaggcagtaagcggccctcgaggggtttctaatcgtcttcctctgctcaagtctggcacacggcctcctgacatctctggctccgaggcctgaggaccgaggctgagttattactgctgctcatacngactaggttagtaagtttcgtttagggtcgttcggggacggtacggggtaacccaaggtcgttacggtaacccggttccgtaacgggttccgaacggtaccccgaaagggtcccgtccgtcccccgttacggttcctacccg

SEQ ID NO: 315386 - DNA, 524 bp, Homo sapiens
  misc_feature: GZ8MTXP02G4RAZ.45.79.H02.1.454.CMB.2.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacngcacccaggcaaagcccccaaatcatgatttangaggcagtaagcgcctgagggtttctaatcgtcttctctgctccaagtctggcaacacggcctccctgacatctctggcctccgaggctgagaccgaggctagattagtactgcttgctcatatgacgtaggtagtagttacgtttggtgttcggacgggtaggaccaagtcgtacggaccgtcgtaggtcaacgccgaacggtctcgccccctggcctaccg

SEQ ID NO: 315387 - DNA, 524 bp, Homo sapiens
  misc_feature: GZ8MTXP02G77VX.45.79.H02.1.454.CMB.2.raw
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataacttgtctctgtaccaacagcaccagcaaagccccaaatcatgatttatgaggcagtaagcggccctnaggggtttctaatcgcttcctctgctcaagtctgcaacacggcctcctgacatctcnggctcgaggctgaggacgnggctgacttatactgctgctcatatcgataggtagttagtactttgggtgttcggcgggaacgggaccaaggctcggaaccgtcccgtaggttccaacgccccgaaacgggctccggcccccgttcggtcctaccg

SEQ ID NO: 315388 - DNA, 532 bp, Homo sapiens
  misc_feature: GZ8MTXP02JY9YY.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtacaacagcaccaggcaaacgccccaaactcatgatttatgaggcagtaagcggccctcgaggggtttctaatcgtcttcctctgctccaagtctggcaacgaccggcctccctgacaatcctctgggcctccgaggcctgaggacgaggctgattattactgactgctcatatgcgaggttagtagtcgtttagggtgttcgggcggacgggacacggcgtcgtaccgtcgtacggtcaacgccaacggcctcgcccccgtcggtcctaccg

SEQ ID NO: 315389 - DNA, 510 bp, Homo sapiens
  misc_feature: GZ8MTXP02GUCLL.45.79.H02.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcacccaggcaaacgcccccaaatcatgatttangaggcagtaagcgcctgagggtttctaatcgtcttcctcgtgctcaagtctggcaacncggcctcctgacatctcgtggctcgagctgagacgngctgattatacngctgctcatatgctaggtagtagttacgtttggtgttcggcggacggacaagctcgaccgtcgaggtcaacgtacccgaggcctccgccccgtcggtactaccg

SEQ ID NO: 315390 - DNA, 571 bp, Homo sapiens
  misc_feature: GZ8MTXP02JBZ3K.45.79.H02.1.454.CMB.2.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatggttgggattataaccttgtctcctggtaccaacngcacccaggacaaacgcccccaaaactcatgatttangaggcagtaagcggcctgagggtttctaatcgtcttcctcgtgcctaccgaagtccgtgccaacacggcccttacccngacaatctctgggcctcgagctagagacgagctagattagttacngtctcgctctatatgcgtaggtagtagttacgtttgggtgttcggggacggtagggaccgtaaaggcgttacggtacccgttaccggtacggtacaaccggacccgtaaacggcccgtacggccccccgttcgggtacctacccg

SEQ ID NO: 315391 - DNA, 495 bp, Homo sapiens
  misc_feature: GZ8MTXP02JK5I3.45.79.H02.1.454.CMB.2.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtagattatactgtctctgtacangcaccngcaaacgccccaaactcatgatttangaggnagtaagcgcctgagggttctagtcgctctcgngctcatctgcacacggcctccngacatctcgtggctcagctgagacgagctgattattactcgctgctcatangcaggtagtagtacgttggtgtcggcggaggaccaaggtctacggaccgtcgttacggcaacggccaaacgggtcctcgccccgtcggtactaccg

SEQ ID NO: 315392 - DNA, 440 bp, Homo sapiens
  misc_feature: GZ8MTXP02GLCWQ.45.79.H02.1.454.CMB.2.raw
  modified_base (431)..(440): a, c, t, g, unknown or other
  misc_feature (431)..(440): n is a, c, g, or t
tcagacgcgatcgacacgaccggtgctcgatttagtgtcacacgaaggggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggatttttgatatcgtggggccaagggacaatggtcaccgtctcttcagcctccaccaaggcccatcggtcttccccctggccacccctcctccaagagccacctcgtgggggcacagcggccctgggctgcctggtcaaggactacttcctcgatcgcgtctgagcgggctggcaggcgcatagnnnnnnnnnn

SEQ ID NO: 315393 - DNA, 541 bp, Homo sapiens
  misc_feature: GZ8MTXP02GRUV2.45.79.H02.1.454.CMB.2.raw
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatactgtctctgtaccangcacccaggcaaacgccccaaatcatgatttatgaggcagtaagcggcctcgtaggggtttctaatcgtcttcctctgctcagtctggcacacggcctcctgacatctcgtgggctcgaggctgacggacaggctggtattattactgtctgtctacatatgactaggttagtagttacgtttgggtcgttcggggacgggtacgggaccgaagtcgtacggtaccgtccgtaggttccaacgtacccgaacggtcctccggcccccgtcggtcctacccg

SEQ ID NO: 315394 - DNA, 615 bp, Homo sapiens
  misc_feature: GZ8MTXP02IQWT7.45.79.H02.1.454.CMB.2.raw
  modified_base (265)..(265): a, c, t, g, unknown or other
  misc_feature (265)..(265): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccagcagtgatggttggagttataacttgtctcctggtacaacngcaccaggacaaacgcccccaaactcatgtaatttatggagggcaagtaagcccggccctacgtaggggtttctaatcgtcttctctgctaccaagtcgtggcaaccgaccggcctcccctgaacaactctcgtgggcctccgaggctgacggacgaggtctagattattacgtgctgccttactagtagtacggngtaagggtttagttaaacggttcgttttggggtcgggttaccggggcgggggaaacggttaccaacggtcctacgggttaaccccgtacgttacgggtacgaaccggaccccgtaaggggtccctcccggtcccccggtttcggacctttcccg

SEQ ID NO: 315395 - DNA, 511 bp, Homo sapiens
  misc_feature: GZ8MTXP02FH9HX.45.79.H02.1.454.CMB.2.raw
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttatgaggcagtaagcggcctcgaggggtttcaatcgcttcctctgctccaagtctggcaacacggcctcctgacaatctctgggctccaggctgaggacgaggctgattattacngctgctcattangctaggtagtagtactttgggtgttcggcggtagggacctaagcttcgaccgtcaggtcaagcccaaggctcgccccgtcgctaccg

SEQ ID NO: 315396 - DNA, 636 bp, Homo sapiens
  misc_feature: GZ8MTXP02IUQYB.45.79.H02.1.454.CMB.2.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgagtggtggattactacttgtctcgtgtacacancaccagacaacgccccaacncatntattagngaggcagtacgccgtcctgtacgggttactagtcgtcttcctcgtcgtctactagtcgtgcaacgaccggtccctccgtacgaactaactcgtacgtcggtcctccgaggtcgtaggacggtacggacgtctagtacttacgttacgtgtacgtcgtactactagttacgtcgtacgtaagggttacgttaacggtttacggtttacgggttcgggttaccggggacggggtaacgggtaaaccgtacgggtccgtaccggtacccggttaccgtacggtaccgtaaccggtacccgtaacgggtcccgtcccggtacccccgttacggtaccctaccg

SEQ ID NO: 315397 - DNA, 570 bp, Homo sapiens
  misc_feature: GZ8MTXP02GBTOU.45.79.H02.1.454.CMB.2.raw
  modified_base (225)..(225): a, c, t, g, unknown or other
  misc_feature (225)..(225): n is a, c, g, or t
  modified_base (354)..(354): a, c, t, g, unknown or other
  misc_feature (354)..(354): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctgtaccacagcaccagcaaacgccccaaatcatgatttatgaggcagtaagcggcctgtagggtttctaatcgtcttcctctgctccagtctggcaacncggcctccctgacatctcgtggcctcgaggctgacggacgaggtctagtacttattacgtgcttgctacatactgacgtaggttagttaggttacgtttggggtcgtttcgggacggggtacgggtaacccgaaggtccgtacggtacccgttaccgtacgggttaccaacggaccccgaaggtccgttcccggcccccgttcgggtccttacccg

SEQ ID NO: 315398 - DNA, 532 bp, Homo sapiens
  misc_feature: GZ8MTXP02GQAD0.45.79.H02.1.454.CMB.2.raw
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
  modified_base (411)..(411): a, c, t, g, unknown or other
  misc_feature (411)..(411): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattatactgtctctgtaccaacagcaccaggcaaacgccccaaactcatgatttatgaggcagtaagcggccctgtacgggtttctaatcgcttcctcgtgctcaagtctgcacacgcctccngacatctcgtggcctcgagctgaggcgagctgattatactgctgctcatntgcgtaggttagtacgttacgtttggtgttcgggacgggacggtaccaaacggtctacggtacccgtactaagggtccaaacggcccgaaggtcctccggtccccctcgggtacctacccg

SEQ ID NO: 315399 - DNA, 538 bp, Homo sapiens
  misc_feature: GZ8MTXP02JBUXY.45.79.H02.1.454.CMB.2.raw
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtggattatactgtctctgacanagcaccagcaacgccccaaatcatgattatgaggcagtacgcggcctgagggtttctaatcgtcttcctctgctcagtctggccaacgacggtccctccngaactactctcgtcggcctccgaggctgacggcgagctagattattacngctcgctacatatgacgtaggttagttagttacgtttgggtcgttcgggtacgggacggaccgtaagtcgtacggtacctcgttacggcaacgtcccgtaaggtccgtccgtacccccgtcggtaccttacccg

SEQ ID NO: 315400 - DNA, 497 bp, Homo sapiens
  misc_feature: GZ8MTXP02HA6IV.45.79.H02.1.454.CMB.2.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacggggtcctgggcccagtctgccctgactcagcctgcctccgtgtctgggtctcctggacagtcgatcaccatctcctgcactggaaccngcagtgatgttggattataaccttgtctctgtaccaacagcaccaggcaaacgcccccaaatcatgatttangaggcagtaagcgccctgagggtttcaatcgcttctctgctcaagtctggcacgacgcctcctgacaatctctggctccaggctgagacgaggctgattagtactgctgctnatatgcaggtagtagttacgtttggtgttcggcggtaggaccaagcgtgaaccgtcgtagtcagcccgagcctcgcccctgtcactcc

SEQ ID NO: 315401 - DNA, 623 bp, Homo sapiens
  misc_feature: GZ8MTXP02GH4Z0.45.79.H02.1.454.CMB.2.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccntctcctgcactggaaccagcagtgatggttggattataacttgtctctggtaccaacagcacccaggacaaacgccccaaatcatgatttangaggcagtagcgcctgtagggttcaatcgtcttcctctgctaccaagtctaggcctaacgaccggtccctccctagaactaatcctcgtcgggcctcccgaggtctagggaacggaccgaggcgtagtaatttacgttactgtacgtgtcctagtattagtacgtacgtaaggttaaggttacgtttaaccggttttgggttcgggtttacgggacggggtaacgggacctaaacggtccgtacggaccccgttaccggtaacgggttaccaaccggaccccgtaacggtccgttccccggacccccgttcggtaccttccccg

SEQ ID NO: 315402 - DNA, 541 bp, Homo sapiens
  misc_feature: GZ8MTXP02H8V5E.45.79.H02.1.454.CMB.2.raw
  modified_base (224)..(224): a, c, t, g, unknown or other
  misc_feature (224)..(224): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatacttgtctctgtaccaacagcacccaggcaaacgcccccaaactcatgatttatgaggcagtaagcggcctgaggggtttctaatcgtcttcctctggctcaagtctgcaacacggccctccctgacaatctcgtgggcctccgaggctgaggacgaggctgattattactgtctgctacatatgacgaggttagtagttactttgggtgtttcgggcggtaaggggacccaaggccgtacggacccgttccgtaacggtcaacgcccgaacggtcctcgcccccgttggtacctaccg

SEQ ID NO: 315403 - DNA, 507 bp, Homo sapiens
  misc_feature: GZ8MTXP02FJ4GF.45.79.H02.1.454.CMB.2.raw
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaacagcacccagcaaacgcccccaaactcatgatttatgaggcagtaagcggccctcaggggtttctaatcgcttcctctggctcaagtctggcaacacggcctccctgacaatctctggctccagctgagacgaggctgattatactgctgctcatatgcaggtagtagtacgtttggtgttcggcggaggaccaagctcgaccgtcctaggtcgaagcccgaagctcgcccctcggtctaccg

SEQ ID NO: 315404 - DNA, 542 bp, Homo sapiens
  misc_feature: GZ8MTXP02JV9VY.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaacagcacccaggcaaacgccccaaactcatgatttatgaggcagtaagcgcctctaggggttctaatcgcttcctctggctcagtctggcaacacggcctcctcgacactctctggctccgaggctgaggacgaggctgattattactgtctgctactatatcgacgtaggtagttagttacgtttggtggttcggtcgggacgggtacgaaacggtctacggtacccgtccgtaaggtcgaacgacccgaagccgtccgccccgtcggtcctacccg

SEQ ID NO: 315405 - DNA, 510 bp, Homo sapiens
  misc_feature: GZ8MTXP02FJLJY.45.79.H02.1.454.CMB.2.raw
  modified_base (427)..(427): a, c, t, g, unknown or other
  misc_feature (427)..(427): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaacgcccccaaatcatgatttatgaggcagtaagcggcctcgagggtttcaatcgcttcctctgctccaagtctggcaacacggcctccctgacaatctctgggctccgagctgaggacgaggctgattattactgctgctcatatcgntaggtagtagtactttggtgttcggcggagggaccaagctcgaccgtcaggtcaagtcccaaggctcgcccctcggtctaccg

SEQ ID NO: 315406 - DNA, 655 bp, Homo sapiens
  misc_feature: GZ8MTXP02JAVAE.45.79.H02.1.454.CMB.2.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (488)..(488): a, c, t, g, unknown or other
  misc_feature (488)..(488): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctcgtgtctggtctccgtggacagtcatcaccatctcctgcacgtggaaccngctagtgagttggttagggtattactaccgttgtcctcgtacgaccaacncgaccaccgagaccaaaccgaccccaaatcatgtattagcggaggcaaggtacgcccgtcctaggtacggtttacacgtccgtcttccgtcgtcgtcctactagtccgcgacctaaccgtcccgtccctactacgaactactccctcgtcggactaccggaggtcgtacggaacgtacggtacgtacgttagttaactttacgttcgcgttntcgttactacgtagttaacgtggtacggttaaggtttaggttaacgtttcgggtttcgggaccgggtaacgggacgggtaacgaaccgtcggacgtttaccggaccgttccggtacgaccgccggtaacccgtacgtcccgtcccgtcccgtacggtcctttccccg

SEQ ID NO: 315407 - DNA, 533 bp, Homo sapiens
  misc_feature: GZ8MTXP02G1EQF.45.79.H02.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaangcacccaggcaaacgcccccaaactcatgatttatgaggcagtaagcggccctgaggggtttctaatcgtcttcctctgctccgaagtctggcaacacggcctccctgacaatctctggctcgagctgagcgaggctgattattactgctgctcatatcgataggtagtaagttcgtttgggtgttcgggcggtagggaccaaggctaggacccgtccgtaggtaccaacggaccccgaaggtcctaccggcccccgtcggtcctacccg

SEQ ID NO: 315408 - DNA, 517 bp, Homo sapiens
  misc_feature: GZ8MTXP02G1N62.45.79.H02.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactggaaccngcagtnatgttgggattataaccttgtctcctggtaccaangcaccagacaaacgccccaaatcatgattangaggcagtaagcgcctgagggttctatcgtcttcctctgctcagtctgcaacncggcctcctgacaatctctggcctcgaggctgacgacgaggctgattatacngtctgtctacatatgcgaggttagtagttacgtttgggtcgttcggacggaggaccaaggtctacggaccgttcgaggtcaacggcccgaacggcctcgccccgtcggtacctaccg

SEQ ID NO: 315409 - DNA, 523 bp, Homo sapiens
  misc_feature: GZ8MTXP02G17AR.45.79.H02.1.454.CMB.2.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatactgtctctgtacacngcaccagcaaagccccaaatcatgatttatgaggcagtaagccggcctgtaggggtttctaatcgtcttcctctgctcagtctgcaacacggcctccctgacactctctggacctcgaggctgaggacgagctagtattatacgtgtctgctacatatgactaggtagtagttacgtttggtggttcggacgggaggtacaacgtctacggtaccgtcgtacggtcaacgcccgaacggtcctaccgcccctacggtctaccg

SEQ ID NO: 315410 - DNA, 550 bp, Homo sapiens
  misc_feature: GZ8MTXP02JUEM7.45.79.H02.1.454.CMB.2.raw
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacagcacccagacaaacgccccaaatcatgatttangaggcagtagcgcctgagggttcatcgnttcctctgctcaagtctggcaacacggccctaccctgacaatctctgggctccgaggctgacggacgacggctagtattattacgngtctgctacagttancgactagggttagttacgttacgttttgggtgttcgggacgggtagggaaccttaacggcgttcggtacccgtcgtagtcgaacgcccgaacgtccgtaccgcccccgtcggtactacccg

SEQ ID NO: 315411 - DNA, 564 bp, Homo sapiens
  misc_feature: GZ8MTXP02H6HUR.45.79.H02.1.454.CMB.2.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattataacttgtctctgtaccaacagaccaccaggacaaacgaccccaaatcatgtatttangaggcagtaacgcgcctgagggttctatcgcttcnctgctacagtctgcaacgacgcctcctagacactctacgtggctacgaggtcagacggacgacgtctagtattatacgtgctgtactanatacgtgacgtaggttaagttagttacgtttgggtcggttacgggacggtaacggaccaagtccgtacggtaacccgtcggtacgtaccgaacggtacccgaaggtccctaccgcccccgtacggtaccctacccg

SEQ ID NO: 315412 - DNA, 570 bp, Homo sapiens
  misc_feature: GZ8MTXP02HVMCZ.45.79.H02.1.454.CMB.2.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtcctcctggacagtcgatcaccatctcctgcactggaaccngcagtgatggttggattatactgtctctgacangcaccagacaacgccccaaatcatgtattangaggnagtaacgcgtcctagtagggttactatcgtcttcctcgtcgtcctaccgtagtccgtgaccaacgtccgtccctaccctagaactactccgtcgtcgcctacgagccgaggaacggaccgtagtacgtagttaacttacgttacgtcgtactcgtactatagtacgtagacggtaagtagttacgtttacgttggtggtcggacggacgtacgacgtcgtaacgccgtacgtcgacaaccgtaccgacgtcccgtccgtacccgtcgtacctcccg

SEQ ID NO: 315413 - DNA, 572 bp, Homo sapiens
  misc_feature: GZ8MTXP02JGBNH.45.79.H02.1.454.CMB.2.raw
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatggtggatatactgtctctgtacacancaccagcaaacgccccaactcatgatttatgaggcagtaagccgcctcgtaggggttctatcgtcttcctctggctccgagtcgtgcaacgacgtcctccctgactaactctcgtgggccctacgacggtcgtaggacggtaccgagggtctacgtattatttaccgngtcgtcgcctatatagtcgagtaggttagtacgtttggtttcggtggttccggacggggtaacggactacggtcgtaccggtaccggttaccgacgtaccgaacgtacccgacggtccgtccccgtacccggtcgtactaccg

SEQ ID NO: 315414 - DNA, 491 bp, Homo sapiens
  misc_feature: GZ8MTXP02FYR7N.45.79.H02.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (397)..(398): a, c, t, g, unknown or other
  misc_feature (397)..(398): n is a, c, g, or t
  modified_base (407)..(407): a, c, t, g, unknown or other
  misc_feature (407)..(407): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtgggattanaacttgtctctgtacaangcaccaggcaaagccccaaatcatgatttatgaggcagtaagcgcctgagggtttcaatcgcttcctctgctccaagtctggcaacacggcctccctgacatctactggctcgagctgagacgagctgatattacnnctgctcatntgcagtagtagtactttggtgttcggcggaggtaccaggtctcgaccgtcagtcaagcccgaagtcctcgccctacggtctacg

SEQ ID NO: 315415 - DNA, 520 bp, Homo sapiens
  misc_feature: GZ8MTXP02JX2L6.45.79.H02.1.454.CMB.2.raw
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatactgtctctgtacaacngcaccagcaaacgccccaaactcatgatttangaggcagtaagcgcctgagggtttctaatcgcttcctctggctccaagtctggccaacgacggtccctcctgacatctcgtggctccgagctgaggcgagctagattactactgctgctcatatgactaggttagtcgttagttggtgttcggcggacggacacggtcgtacgtaccgtacgttacgcgaacgtcccgaagtcctaccgtccccgtaggtcctaccg

SEQ ID NO: 315416 - DNA, 556 bp, Homo sapiens
  misc_feature: GZ8MTXP02JG98V.45.79.H02.1.454.CMB.2.raw
  modified_base (269)..(269): a, c, t, g, unknown or other
  misc_feature (269)..(269): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacngcacccaggcaaacgcccccaaatcatgatttatgaggcagtaagcggccctgagggtttctaatcgtcttcctctggctccaagtctggcaacacggcctccctgacatctcgtggctccgaggctgaggcgaggctagattattacngctgctcatatgactaggttagtagttacgtttgggtgttcgggacgggacgggtaccaaacggtccgtacggtacccgtaccgtagggtaccaacggccccgaaaggcccttccggcccccgttggtaccctacccg

SEQ ID NO: 315417 - DNA, 551 bp, Homo sapiens
  misc_feature: GZ8MTXP02FPBVT.45.79.H02.1.454.CMB.2.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataacttgtctctgtacaacngcaccagcaaacgccccaaatcatgatttangaggcagtagcgccctgtagggtttcatcgtcttcctctggctcagtctggcaacacgcctcctgacatctcgtggcctcgaggctagacggacggaggtctagtattacttacgtgctgcctnattangacgtaggtagttacgttacgtttgggtcgttacgggacgggacgggaccaaggtcttacggacccgtacgtaggtaccgaacggtacccgaaggtccgtacccggtcccccgtcggtcctacccg

SEQ ID NO: 315418 - DNA, 538 bp, Homo sapiens
  misc_feature: GZ8MTXP02F6HTN.45.79.H02.1.454.CMB.2.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggcctgcactggaaccaanagtgatgttgggatttttagtttgtctcctggtaccaacaacaccccgnaacgccccaaataatcatttanaggacactaagcggcctcggggtttcaagtcgcttctctgctccaaagtctggcaacacgcctccctgacatcntggctcaggctcagacgagctgattatttcngttnctntatatgcgaggacagctagttgggtcgttcgggcggacggacgtaggtcgaccgtcgtacggacacgacccgaaggcctccgccccgtgtaccncgttcctccgttccccncccttcctctcgtacg

SEQ ID NO: 315419 - DNA, 779 bp, Homo sapiens
  misc_feature: GZ8MTXP02G6OXY.45.79.H02.1.454.CMB.2.raw
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactgaaccngcagtgatggttggattatacttgtctctgtaccangcaccagacaaacgccccaatcatgtattagngaggcagtacgcgtcctgtagggttactagtcgtcttccgtcgtcgtcctaccgaagttcgtacgggacctaaccggtacccggtccccttacccgtacgtaaaccctaacgttcccgtacggttccggggtcccttacccggaacggggtcccgttagggggaaacggggtacccgggtaagggtaccgtttacggttaaagttttaacgtttaaaccgttcgggtaccgtttcggtacccgttaactaagttaacgttacgggtaaccgtaaagggggtttaacgtttaagggtttaaccggtttttagggggttcggggtttaccgggggaaccggggtaaacggggtaacccggtaaaacggtccggttaccgggtaaccccggttaccggttaacgggacccgtaaaccgggaacccccggttaaaccggggtccccgtacccccgggttccccccgttacgggttaaccccgttacccccg

SEQ ID NO: 315420 - DNA, 519 bp, Homo sapiens
  misc_feature: GZ8MTXP02FZ17E.45.79.H02.1.454.CMB.2.raw
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacccttgtctcctggtaccaacagcacccaggcaaagcccccaaatcatgatttangaggcagtaagcggcctgaggggtttcaatcgcttcctctgctccaagtctgcaacacggcctcctgacatctcgtggctcaggctgaggacgaggctgtattattactgttagctcattatgacgtaggggaccaggtctacgttggggtgttcggcgggaggacctaggtcgaccgttcgtacgtcagccgaaggctacgccccctggccacttccg

SEQ ID NO: 315421 - DNA, 540 bp, Homo sapiens
  misc_feature: GZ8MTXP02G0VPJ.45.79.H02.1.454.CMB.2.raw
  modified_base (225)..(225): a, c, t, g, unknown or other
  misc_feature (225)..(225): n is a, c, g, or t
  modified_base (416)..(416): a, c, t, g, unknown or other
  misc_feature (416)..(416): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctcctggtaccaacagcacccaggcaaagcccccaaaatcatgatttatgaggcagtaagcgccctgaggggtttctaatcgcttcctctgctcaagtctggctaacacggcctcctgacaatctctggctcgagctgagacgagtctgattagtactgctgctnatactgacaggttagtagttacgtttggtgttcgggacgggacgggtaccaaagtcgtacggtacccgtccgtaaggttccgaacgccccgaaaagggtcctcggccccctcggtactaacccg

SEQ ID NO: 315422 - DNA, 531 bp, Homo sapiens
  misc_feature: GZ8MTXP02F8U8Q.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatggttgggattataaccttgtctcctgtaccaacagcacccaggcaaacgcccccaaatcatgatttatgaggcagtaagcgcctgtagggtttctaatcgcttcctctgctcaagtctggcaacacggcctccctgacatctcgtggcctcgagctgagcgagctgattatactgctgctctatatgcgacggacagctacgttgggtcggttcggcgggagggacccgtagggttccgaccgtaccgtacggtcaacggtcccgaaaggtccgtccgtaccccctcggtccctaccg

SEQ ID NO: 315423 - DNA, 510 bp, Homo sapiens
  misc_feature: GZ8MTXP02J0SAR.45.79.H02.1.454.CMB.2.raw
  modified_base (225)..(225): a, c, t, g, unknown or other
  misc_feature (225)..(225): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataacttgtctcctggtaccaacagcacccaggcaaagccccaaatcatgatttatgaggcagtaagcggcctgaggggtttctaatcgcttcctctggctccaagtctggcaacacggcctccngacatctctggctccgagctgaggacgnggctgacttattactgctgctcatangcgtaggtagtagttactttggtgttcggcggacggaccaaggctgaccgtcgtagtcaagcccgaagcgtacgcccctcggctaccg

SEQ ID NO: 315424 - DNA, 501 bp, Homo sapiens
  misc_feature: GZ8MTXP02IBZDO.45.79.H02.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatactntctcngtacangcaccagcaaacgccccaaactcatgatttangaggcagtaagcgcctcgtagggttactatcgcttcctctgctacagtctgcaacacgcctcctgacaatcnctggctcagctgagacgagctagattatatgtctgctacatatcgagagtagtagttacgtttggtgttcgggacggacggtaacagtcgtacgtaccgtctaggtcaacgaccgaacgctccgcccctcggactccg

SEQ ID NO: 315425 - DNA, 593 bp, Homo sapiens
  misc_feature: GZ8MTXP02JC29Q.45.79.H02.1.454.CMB.2.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtggattatacttgtctctgtaccaacagcacccaggaccaaacgcccccaaatcatgtatttangaggcagtaacgccggccctgtaggggtttctaatcgtctttctcgtggctaccaagttccgtgggctaacgtacccgggtccctcccgtcgacctacttctcgtgggccttccgaaggtctagaacgacggtacgctgtattactacgtgcaagcaactatattacttagttcgtttaccgacgtacggttacgtcgggacggtacggtaccctaaggttcgaaccgtcgtacgggtaccacggtacccgaaggtcctccgtacccccgtcggtacctacgttccgtttccccgg

SEQ ID NO: 315426 - DNA, 759 bp, Homo sapiens
  misc_feature: GZ8MTXP02JNBPA.45.79.H02.1.454.CMB.2.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataacttgtctctgtaccaacngcacccaggacaaacgcccccaaactcatgatttangaggcagtaagcgcctgtaggggtttactaatcgtcttccgtctggtcctaccgtaagtcctagggccaaaccgtaccgggtcccccttacccgtacggaaaccctaaacgttcccgttaccgttcgggggtacccttacccgaacggggtccgttacgggaaacggggtaccggaaacggggtcccgttagggtaacttttaacgtttaacccgttcggttaccgttcggacccgtttaccgaactttaacgttggaaccgttaaagggggtttaacgtttaacgggttttaaccggttttgggggttacgggttttccgggggtaccggggaacgggggtaacccgtaaacggtaccggttaccgggtacccgttacccggttaacggtacccgaacggtaccccgaaacgggtcccgtacccggtaccccccgttccgggtacccttaccccgg

SEQ ID NO: 315427 - DNA, 531 bp, Homo sapiens
  misc_feature: GZ8MTXP02JKSV0.45.79.H02.1.454.CMB.2.raw
  modified_base (299)..(299): a, c, t, g, unknown or other
  misc_feature (299)..(299): n is a, c, g, or t
  modified_base (379)..(379): a, c, t, g, unknown or other
  misc_feature (379)..(379): n is a, c, g, or t
  modified_base (425)..(425): a, c, t, g, unknown or other
  misc_feature (425)..(425): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctccccactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttangaggcagtaagcggccctgaggggtttctaaatcgcttctcctggcctcaagtctggcacacggcctccctgacatctcngggctccagctgaggacgaggctgattatactgctagctcattagngactaggtagtacgttatttgggtgttcgggcggagggaccaagcgtagacccgtctaagggtccaagccccgaaggtcctacggcccccttggtacaccgttccg

SEQ ID NO: 315428 - DNA, 566 bp, Homo sapiens
  misc_feature: GZ8MTXP02FV8S8.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatacttgtctctggtaccaangcacccagacaaacgccccaaatcatgtatttangaggcagtaagccgcctgtagggtttcaatcgcttcctctggctccaagtctgcaacnccggtcctccctgaacacgtctcgtggcctcgagctgacgcgagctgattatactgacttcgctctatatcgtgtaggtagttagttacggtttgggtacgttcggggacggtacgggacctaacggtccgttacggtacccgttaccgacggtaccaacggtaccccgtaacggcccgttacccggccccttccgggtctttaaccccg

SEQ ID NO: 315429 - DNA, 539 bp, Homo sapiens
  misc_feature: GZ8MTXP02JGTS3.45.79.H02.1.454.CMB.2.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcacccaggcaaacgcccccaaaactcatgatttangaggcagtaagcgcctgagggtttcaatcgcttccnctggctccaagtctggccaacgcggcctccctgacaaactctctgggactccaggctgaaggacgagctgattattactgctnctntatatgagtaggtagttagttagtttggttggttacggtacggacggacgaacgacgtacgtaccgtaccgtacgtacgaacgaccgacgacgtccgtcccgtccgtaccgtcg

SEQ ID NO: 315430 - DNA, 573 bp, Homo sapiens
  misc_feature: GZ8MTXP02I3ECE.45.79.H02.1.454.CMB.2.raw
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtgggattataacttgtctcctggtaccaacagcacccaggacaaacgcccccaaactnactgatttatgaggcagtaacgccggccctcgtagggtttactaagtcgcttcctctcggtctaccgaagtcgtggccaaaccgaccggtccctacccgtgaacaaactcctcgtcggctccgagcgtgacggcgagcgtagattattactgactgctactataagtgcgtaggtagttagttacgtttggtcggttcggacggacggactaacgcgtacgaccgtacgtcggtaccgaacgtcccgaaacggtcctaccgtccccgtacggtctacccg

SEQ ID NO: 315431 - DNA, 532 bp, Homo sapiens
  misc_feature: GZ8MTXP02G5NK0.45.79.H02.1.454.CMB.2.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactgaccagcagtgatgttggagttatacttgtctctgtacaacngcacccaggacaaaccncccccaaactcatgtatttangaggcagtaacgccggcctgtacggggtttntaactcgtctccgtctcggctaccaagtctggcaacnccggccctcctgaacatctcngccncagcngngacgngctnattntacgtgctgtctcatctgngtagtagtagtattcggtgtcgggtcggacggacgtaacgcgtacgccggtacgtcggtacaacggtacccgaggtaccgtccgcccccgtacggtctcccg

SEQ ID NO: 315432 - DNA, 588 bp, Homo sapiens
  misc_feature: GZ8MTXP02GQQRX.45.79.H02.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (263)..(264): a, c, t, g, unknown or other
  misc_feature (263)..(264): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgatggttggattatacttntctctgtacacnncaccagacaacgacccaatnatntattangaggcagtagcgcctgtaggttctagtcgtcttcctcgtgtctacagtctgcacncgcctccnacatctcgtggctcgaggcgaggacgacgagtctagtacttattacgtgtctcgtctactatagtagtacgtaagggttagttaacggtttacggtttggggtacggttaccggggacgggtaacggggtaaaccgtaaacggtccgttacggtacccgttaccgtaacgggtaccgaaccggtaccccggtaacggtcccgtacccggtacccccgttcggtacctacccg

SEQ ID NO: 315433 - DNA, 591 bp, Homo sapiens
  misc_feature: GZ8MTXP02HJI74.45.79.H02.1.454.CMB.2.raw
  modified_base (302)..(302): a, c, t, g, unknown or other
  misc_feature (302)..(302): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctcctggtaccaacagcacccaggcaaacgcccccaaatcatgatttangaggcagtagcgcctgagggttctaatcgtcttcctctgctccaagtctgggcaacacggcctacccgtgacaatcctacgtgggaccttcccgaggctgacggacgaggctgtattattactgtctgtctacatactgcgaaggttagttaaggttacgtttcgggttggttcgggtcgggaacggggtacccgaaaggtcgttacggacccggttaccgttaacggggttccaacggtacccgaaacgggtccctaccggtccccccgttcgggttaccgtaccccg

SEQ ID NO: 315434 - DNA, 539 bp, Homo sapiens
  misc_feature: GZ8MTXP02FMETW.45.79.H02.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacngcacccaggcaaacgccccaaatcatgatttangaggcagtaagcggccctcgtaggggtttctaatcgcttcctctgctccaagtctggcaacacggcctccctgaccatctcgtgggacctcgaggctagaacgcgaggctgattattacngcagcacatatattagtgtttaccacgttcgggtattccgggacggtacgggacctaaaggttcgaaaccgtcgtacggtacacggaccccaaggtcctcgcccccgtgtcacctctcccg

SEQ ID NO: 315435 - DNA, 565 bp, Homo sapiens
  misc_feature: GZ8MTXP02GDGYH.45.79.H02.1.454.CMB.2.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcacatctcctgcactggaaccagcagtgatggttggattataacttgtctctgtaccangcaccagacaaacgccccaaacncatgtatttangaggcagtaacgccggcctgtagggtttctaatcgtcttcctctcgctcagtctgcaacgccgcctccagactatcctcgtcggtcctcgaggtctggaggacgagcttgaactttacgtacgtgtactgtctcgtatctgacgtaggttagtacgtttagttggttcggttacgggacggtacgggaacctaggtaccgtacggtacccgtaccggtacggttaccaacgtacccgacggttccacccggtccccgtcgtacctcccg

SEQ ID NO: 315436 - DNA, 661 bp, Homo sapiens
  misc_feature: GZ8MTXP02HU3MH.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattatacttgtctctgtaccangcaccagcaaacgccccaaatcatgatttangaggcagtaacgcgcctgtagggtttctaatcgtctttcctctggtctaccaagtcctgggcaaaccgacggtccctcccgtacgactaaattcctcgtacgggcctaccgaggctaggaggaccgaaggtcctaggtaatttacgttacgttcggtacttcggtacttactaacgtaacgttggaccgtaagggtttaaggttaaggtttaaccgttttgggttcgggtttaccgggggtacgggaaacggggttaaccgaaacggttccgttaaacggccccggttaccgttaacggggttaccaaccggttaccccgaaacggtccgtaccccggtccccccgttacgggtttcccttaaccccgg

SEQ ID NO: 315437 - DNA, 531 bp, Homo sapiens
  misc_feature: GZ8MTXP02IAPU1.45.79.H02.1.454.CMB.2.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (412)..(412): a, c, t, g, unknown or other
  misc_feature (412)..(412): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgatgttgggattataactgtctctggtaccaangcaccaggcaaacgccccaaactcatgatttangaggcagtaagcggcctgagggtttctaatcgcttcctctggctccaagtctggcaacgacgcctcctgacatcnctggctcgagctgagacgagctgattatactgctgtctnatatcgagtaggtagtagttacgtttgggtcggttcgggacggagggtaccgaaagtcgtacgtaccgtccgttaggacaacggacccgaacggcgtccgcccccgtcggttccacccg

SEQ ID NO: 315438 - DNA, 519 bp, Homo sapiens
  misc_feature: GZ8MTXP02GC3CB.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccangcaccagcaaagccccaaancatgatttatgaggnagtaagcggccctgtaggggtttctaatcgtcttccctctcggctaccgaagtctaggcaacaccggcctccctgacaatctcgtggcctcaggctgacgcgaggctgattatacgtgctgctctatatgacgtaggtagtagttactttgggtgttcgggcggtagggacctaagctagaccgtctaggtcaagccgaagcctcgcccctcggtctaccg

SEQ ID NO: 315439 - DNA, 481 bp, Homo sapiens
  misc_feature: GZ8MTXP02I452U.45.79.H02.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (282)..(285): a, c, t, g, unknown or other
  misc_feature (282)..(285): n is a, c, g, or t
  modified_base (288)..(288): a, c, t, g, unknown or other
  misc_feature (288)..(288): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (371)..(372): a, c, t, g, unknown or other
  misc_feature (371)..(372): n is a, c, g, or t
  modified_base (380)..(383): a, c, t, g, unknown or other
  misc_feature (380)..(383): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattanaaccttgtctctggtaccaacnncncngcaacnccaannnnatngagcagacgcgctgtaggttctatcgctcctgtcgctcatctgcacncgcctccncacactctctcgcncgngntgagagngnngatatatnnnntntatangagtagtagtagttagttgtgtcggtcggaggacgacgcgtacgtaccgtacgtacgtcgaacgaccgacgcgtccgtcccgtcgtcgtcg

SEQ ID NO: 315440 - DNA, 539 bp, Homo sapiens
  misc_feature: GZ8MTXP02F39ER.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactggaaccngcagtgatgttgggattataacttgtctcctggtaccaacagcaccaggcaaagccccaaactcatgatttatgaggcagtaagcggccctcgtaggggtttctaatcgcttcctctcggctccaagtctggcacaccggctccctgacaatctctggctccaggctgagcgaggctgattattactgctgctcatatgcgagtagtagtactttggtgttcgggcggtagggtaccaaaggtccgtacggacccgtccgtaggttaccgaacggcccgaaacgggccttccgcccccgtacggtactcccgg

SEQ ID NO: 315441 - DNA, 600 bp, Homo sapiens
  misc_feature: GZ8MTXP02GLQMX.45.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgattggttaggattataacttgtctctagacaanagcaccagacaaacgaccccaaatcatntattangaggcagtaacgccggcctacgtagggtttactaagtcgtcttcctcgtcgctactaagtcgtggaccaacgaccggtcctaccgtagactaactctcgtcggtacctaccgaggtcgtaggaacggacgtaggtctagtacttacttacgtgtctgtcttacatatagtcgtaaggttacgttagttacgtttggtacgggttcgggacgggacggtaacgtaacggtcgtacggtaccgtaccgttaacggaccgaaccgaccgaacggtccctccggtccccgttacggtacctaccg

SEQ ID NO: 315442 - DNA, 554 bp, Homo sapiens
  misc_feature: GZ8MTXP02FQSD8.45.79.H02.1.454.CMB.2.raw
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctggtaccaacagcacccaggacaaacgcccccaaatcatgatttatgaggcagtaagcggccctgtagggtttcaatcgcttctctgctccaagtctggcaacncggcctccctgacatctctggcctcagctgaggacgaggctgattnttactgctgctcatatgactaggtagtagttacgtttggtaggttcgggtacgggaggggtaaccaacggtctacgggacccgttaccgtaggttacccgaacgtaccccgaaaggtccctaccggccccccgtcgggttcctacccg

SEQ ID NO: 315443 - DNA, 535 bp, Homo sapiens
  misc_feature: GZ8MTXP02F41VT.45.79.H02.1.454.CMB.2.raw
  modified_base (423)..(423): a, c, t, g, unknown or other
  misc_feature (423)..(423): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcaccaggcaaagcccccaaatcatgatttatgaggcagtaagcggcctgagggtttcaatcgcttctctggctcaagtctggcaacacggcctccctgacaatctcgtgggcctcgaggctggaggacgaggctgattattactgctgctcatangctaggtagtagttactttggtgttcgggacggagggtaccaaaggctacggtaccgtccgtacgggttcaacggtcccaaagggtcctacgcccccgttcggtcctacccg

SEQ ID NO: 315444 - DNA, 769 bp, Homo sapiens
  misc_feature: GZ8MTXP02GW4F5.45.79.H02.1.454.CMB.2.raw
  modified_base (266)..(266): a, c, t, g, unknown or other
  misc_feature (266)..(266): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgagtgttgggattataaccttgtctcctggtaccanagcaccaggacaaacgcccccaaatcatcgtaatttactggaggcaaggtaaagcccgggtccctacggtaggggtttactaaagtccggtctttacccctcgtcgggtcttacccgtaaaggttccgttaggggaccctaaaaccggtacccggggtacccccttacccccgttacggaaaccctaaaacgtttcccgttacccgtcgggggtcccttacccgaaaggggtcccgttagggaacggggaaccggacgggaccgttaaggtattttaacgttaacgtcggtaccttcggtactcctaaagttcctagtaccgtaagggtttaagttaacggtttaccgttttggggttacgggttaccggggtacgggtaaagggggaaccctaaacgggtccgtaccgggtaaccccgtaccggttaacggggtccgaaaccggaccccgtaaaacgggtcccgtacccggtccccccgttaacgggtccctttaaccccgg

SEQ ID NO: 315445 - DNA, 541 bp, Homo sapiens
  misc_feature: GZ8MTXP02II671.45.79.H02.1.454.CMB.2.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (505)..(505): a, c, t, g, unknown or other
  misc_feature (505)..(505): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttggattataacttgtctcctgtaccaacngcacccaggacaaacgcccccaaatcatgtatttangaggcagtaacgccgcctgtagggttctaatcgtcttcctctggctacagtctggcaacgacgcctccngacatctctcggctccagtctgagacgagctgattntatcgctcgtctactatatgacgtaggtagttaggttacgtttgggtcgttcgggacgggtaacggacctaacgcgtacgaccgtcgtacgtaccgngaccccgaggccgtcccgtccccctcggtcctaccg

SEQ ID NO: 315446 - DNA, 591 bp, Homo sapiens
  misc_feature: GZ8MTXP02FGUO7.45.79.H02.1.454.CMB.2.raw
  modified_base (297)..(297): a, c, t, g, unknown or other
  misc_feature (297)..(297): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccagcagtgatgttgggattataaccttgtctctggtacaacagcaccaggcaaacgccccaaatcatgatttangaggcagtaacgcggcctgtagggtttcaatcgtcttcctctggctccaagtctggccaacgacggcctcctgaacacttctcgtgggctccgaggtctgacgacggaggtctgtatttattactgactgctctaatagtcgacgtaggttaggttagttacgtttggggtacgtttcggggacgggtacggggaacccgtaaaggaccgttcggaacccggttaccgtaacgggtaccgaacggaccccgtaaacggggcccgtacccgtccccccggtcggttacctacccg

SEQ ID NO: 315447 - DNA, 612 bp, Homo sapiens
  misc_feature: GZ8MTXP02HM1XU.45.79.H02.1.454.CMB.2.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcatcaccatctcctgcactggaaccngcagtgattggttggattactaacttgtctctgtacacngccaccaggcaaacgccccaatcatgatttangaggcagacgcgcctagaggttctaagtcgcttcnctgctcagtctgccaacgacgtcctccagacatcctcgtacggccttcgaggcgtaggaacggaccggtaggccgtagtattacttacgtcgtcttcgtctatagtatgaccgttaaggtagttagtttaaccggtttgggttcggtaccgggttcggggaaacggtaccgtaaacggtccggttaacgaccccgggttacgtaaccgggttaccgaacccggtacccgaaccggtacccgtacccggtacccccccgttgggttaacccctttcccccgg

SEQ ID NO: 315448 - DNA, 552 bp, Homo sapiens
  misc_feature: GZ8MTXP02GX4FC.45.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (422)..(422): a, c, t, g, unknown or other
  misc_feature (422)..(422): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctggtaccaangcaccagacaaacgccccaaatcatgatttangaggcagtaagccggcctgtaggggtttctaatcgtcttcctctgctcaagtctggcaacacggtcctcctgacactctcgtcgggactccgaggctggaggacgaggtctagtattattaccgngtctgctcatactgacgtaggttagtaacgttcgtttgggtgttcgggacggacgggaccaaacggcgtacggaccgttcctaaggtccaacggtcccgaacggtccgtccgtccccgtcggtactcccg

SEQ ID NO: 315449 - DNA, 630 bp, Homo sapiens
  misc_feature: GZ8MTXP02JS4AZ.45.79.H02.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (476)..(476): a, c, t, g, unknown or other
  misc_feature (476)..(476): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgtggattataactgtctctgtaccaacagcacccaggacaaacgccccaaactcatgatttangaggcagtaagcgccctgagggtttacaagtcgtcttacctcgtacggctaccgaagttcgtagggaccaaacgaccggcccttacccgtagaaccaacttcctcgtcgggcccttacccgaggcctaggacggaccgaaggtctagtaagttattacgtcgtctcgtctacattacgngtacgtaaggttaagttagtttacggtttaggtcggttacgggacggggtaacggtaaccgtacggtaccgtaccggtacccgttaccggtaacggtaccgtaaccggacccggtaacggtcccgtcccgtcccccgttacggtaccctacccg

SEQ ID NO: 315450 - DNA, 552 bp, Homo sapiens
  misc_feature: GZ8MTXP02HG6G9.45.79.H02.1.454.CMB.2.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcncctgcactggaaccngcagtgatgttgggattataaccttgtctctggtaccaangcacccagcaaacgccccaaactcatgtatttatgaggcagtaagcgcctcgagggttctatcgtcttcctctgctcagtctgcaacncgcctcctgacanctcnggctcagctgagacgngctgattatactgtctgtctacatatgacgtaggttacgtagtttacgtttggtcggttcgggacgggacggggtacaacggcgtacggtacccgttacgtacgggttaccgaacggtacccgaaacgggtccctccggccccccgttcgggtacccttaccccg

SEQ ID NO: 315451 - DNA, 628 bp, Homo sapiens
  misc_feature: GZ8MTXP02H7SZ4.45.79.H02.1.454.CMB.2.raw
  modified_base (446)..(446): a, c, t, g, unknown or other
  misc_feature (446)..(446): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactggaaccagcagtgattggttggattataacttgtctctgtaccacagccaccacggacaaacgaccccaaactcatcgtatttactgaggcagtaacgccggtacctcgtagggtttctaagtccgtcttccctcgtcggtcctaccgtaagttcgttcgggacctaaaccgaccggcccttcccgtacgacctaattcctccgttcgggccttcccgacggtccngggacggacggacggctaggtatttaacgtacgttcgtctcggtctatattacgtgtacgtaagggtacgttagtttaccgtttgggttcggttcgggacggacggtacgacgtacgtcgtacccgtacgtacggtacgaaccggtaccgaacgtccgtaccgtccccgtcggtacctccgg

SEQ ID NO: 315452 - DNA, 604 bp, Homo sapiens
  misc_feature: GZ8MTXP02H5Z6T.45.79.H02.1.454.CMB.2.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgagttggttagggaattactacttgtctcgtcgacaacacgcaccagacaacacccaacnatntattangaggnagtacgcgctgtaggttactatcgtcttcctcgtcgtctacgtacgtcgtacgccaaccgaccggtccctaccgtacgtactaactccgtacgtcggcctccgacggtcgtaggaacgggacggacggtactagttacttacgttacgtcgtctcgtctactatagtacgtacgtaaggttagttacgtttacggtttgggtcggttcggggacgggtacggtaccgtaacgtcgtacggtaccgtacgtacggtaccgaacggaccgacgccgtaccgtaccccgtcggtacctccg

SEQ ID NO: 315453 - DNA, 577 bp, Homo sapiens
  misc_feature: GZ8MTXP02IYZDD.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattataacttgtctctgtacaacngcaccagacaaacgcccccaaancatgatttatgaggcaagtagccggtccctcgtacggggtttctaatcgtcttcctcgtgctcaagtctgcaacgacggtcctaccctgacaatctcgtggcctcgagctggagccgagctagattattactgtctgctacagtatcgacgtaggttagttaacggttgtttgggtggtttacgggacgggtagggaaccctaagggtactacggtacccgttacgtaacggttacgaaccgtaaccccggaaggtcccgttccggtaccccccgttgggtaccctacccg

SEQ ID NO: 315454 - DNA, 805 bp, Homo sapiens
  misc_feature: GZ8MTXP02FQ7MW.45.79.H02.1.454.CMB.2.raw
  modified_base (226)..(226): a, c, t, g, unknown or other
  misc_feature (226)..(226): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgtatggttagggatttataacctttgtcctccgtggtaaccaacacgccacccaggaccaaacgacccccaaactcatagtatttatggaggcaagtaacggccggccctacggtacgggtttactaatcgtcttcccgtcgtcggcttacctaagtccgtaggacctaaaccgacccgggtcccttccccgtagtaacctaaacgttcccgttccgttcgggtacccttacccggacggtaccgtaggaaacggggaccggtaacggggtaccttaggtaaacttttaacgtttaaccgttcggtacctttcggaccttaccttaacgtttaaagtcggtaaccgttaaggggtttaaggtttaaacggttttaccggttttagggggtttcggggtttacccggggaacgggggtaaaccggggttaaacccgtaaaacgggttcccgttaaaccgggttaccccggttaaccggttaaccgggttaccggaacccggttaaccccggaaacgggttacccccggttcccccggtaaccccccggtttcccgggttaccctttaacccccgg

SEQ ID NO: 315455 - DNA, 638 bp, Homo sapiens
  misc_feature: GZ8MTXP02FZCTL.45.79.H02.1.454.CMB.2.raw
  modified_base (264)..(264): a, c, t, g, unknown or other
  misc_feature (264)..(264): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcacgtggaaccagcagtgatggtgggattataacttgtctctgtaccaangcaccagacaaacgccccaaatcatgatttataggaggcagtaacgcggtccctgtagggtttcaatccgtcttcctctgtctccaagtctaggccaacgaccggccctcccgtagaacctaatctcgtcgggtccttacccgaggcctgggaaggaccggtaggtccgttagttaactttaactttaaccgttcgcgttcggcttacgtaattagtacggaccgttaagggttaggtttaagtttacggttttgggtcgggttcggggtacggaaccggggtaaaccgtaggtaccgttcggacccgttacgtacgggtaccaacggccccggaacggtcccgtccggtacccccgtacggttacctaccccg

SEQ ID NO: 315456 - DNA, 537 bp, Homo sapiens
  misc_feature: GZ8MTXP02IP9A2.45.79.H02.1.454.CMB.2.raw
  modified_base (301)..(301): a, c, t, g, unknown or other
  misc_feature (301)..(301): n is a, c, g, or t
  modified_base (407)..(407): a, c, t, g, unknown or other
  misc_feature (407)..(407): n is a, c, g, or t
  modified_base (421)..(422): a, c, t, g, unknown or other
  misc_feature (421)..(422): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctgtaccaacagcacccaggccaaagcccccaaatcatgatttangaggcagtaagcggccctgagggtttctaatcgcttctctgctccagtcctggcctaacgccggccctccccgtgacaactctcgtggctccgagctagaggacgnggctgattattacnnctgntcattacngcaggttagtagttacgtttgggtgttcgggacggacgggacacgacgtacggtacccgttcgtaggtcaacggtccaacgggcctcgccccctggcctaccg

SEQ ID NO: 315457 - DNA, 526 bp, Homo sapiens
  misc_feature: GZ8MTXP02HVCCS.45.79.H02.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (254)..(255): a, c, t, g, unknown or other
  misc_feature (254)..(255): n is a, c, g, or t
  modified_base (285)..(285): a, c, t, g, unknown or other
  misc_feature (285)..(285): n is a, c, g, or t
  modified_base (357)..(357): a, c, t, g, unknown or other
  misc_feature (357)..(357): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaccngcagtgatgtggattatactgctcngtacanncaccagcaaacgccccaaatcatgatttangaggcagaagcggcctagagggttctaagtcgtcttctctgctccaagtctggcacacgcctcctgacatcntggctcgagctgagacgagctagacttattacgtgtctcgtcttacagttactgacgtaggttagtagttacgtttgggtgttcgggcggtaacggaccgtaaagtccgttacggaccgttaccgtaggtccaacgcccgtaacggcctacgtccccctggtacctccg

SEQ ID NO: 315458 - DNA, 644 bp, Homo sapiens
  misc_feature: GZ8MTXP02HM9UQ.45.79.H02.1.454.CMB.2.raw
  modified_base (155)..(155): a, c, t, g, unknown or other
  misc_feature (155)..(155): n is a, c, g, or t
  modified_base (227)..(227): a, c, t, g, unknown or other
  misc_feature (227)..(227): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggatcgtgggccctttntgccctgactcagcctgcctccgtgtctgggtctcctggacagtcgatcaccatggcctgcactggaaccanagtgatggttggtattttagtttgtctctggtaccaacaccacccggcgaacgaccccaaatatcattataggacacgtaagcgccgtcggggttacagtcncttctctgctcagtctcggcaacncggcctcctgacatctctgggcctccgaggctcgagggacgaggctagtatttatttcgttgttcgcttactattagtcggacgaacggggaccctagtccgttacgggtttggggtcgggtttccggggcggggtaacggggtacccgtaaggggtttcggaacccgttcccggtaggggtacccgaccggtaccccggtaaaggtcccgtccggtacccccccgttgggtaccctaaccgttcccgttacccggtttcccccacccctttcccgtccgtttaccgtccg

SEQ ID NO: 315459 - DNA, 570 bp, Homo sapiens
  misc_feature: GZ8MTXP02FUZKX.45.79.H02.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatggttgggattataaccttgtctctgtaccaacagcacccagcaaacgcccccaaancatgatttangaggcagtaagccggccctgtagggtttcaagtcgtcttcctctggctccgaagtctggcaacncggcctcccngacatctacgtggctcgagctgagacgagctgattattactgctgctcatgtcgacgtaggttagtaagttcgtttgggtcgttacggggacgggtacggggaaacctaaacggtccgttacgtacccggttaccgtacggtaccgaaccggtacccgaaacggtcccgtacccgtcccccgtcggttacctacccg

SEQ ID NO: 315460 - DNA, 637 bp, Homo sapiens
  misc_feature: GZ8MTXP02GLGS2.45.79.H02.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccngcagtgagttggttaggtattactacttgtctcgtacgacacacgccaccagaccaaaccgaccccaaactcatntattagtaggaggactaaggtacgccgtacctcggtagggttactacgtcgtcttcctcgtcgtctacgtacgtcgtacgccaaccgccgtcctccgtacgaactactccgtcgtcggtcctccgaggcgtaggacggacggagtcgtagtattacgttacgtcgtcgtgtactataagtcgtacgtacgtagggttaacgtttacggtttacggtttcggggtacgggttccggggaacgggtaacggtaaccgtacggtccgtaccggtaccgttaccgtacggtaccgaaccgtaccgtacgtcccgtcccgtccccgtcggtacccgtaccg

SEQ ID NO: 315461 - DNA, 691 bp, Homo sapiens
  misc_feature: GZ8MTXP02GC59D.45.79.H02.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgttgggattataacttgtctctgtacanagcaccagacaacgccccaaactcatnatttatgaggacagtaagcggccctcgtagggtttctaagtcgtctttcctcgtggtctaccgtaagtcctacgggtccaaaccgaccggtccctacccctacgaactaaacttccttccgtacgggtcccttacccgagggtacccgttaggaaacggggaccggacggggtaccttagggtaactttaacgtttaaccgttcggtaccgttcggtacttacctaagtttaacgttaccggtacggttaagggttaaccggtttaaaaggtttacccgtttttggggttacgggttccgggtacgggttaacgggaccgtaaacgtcgtacgggtacccgttaccgtacggtaccgaacgtacccgtaacggcccgtccgcccccgtacggtaccttccccg

SEQ ID NO: 315462 - DNA, 543 bp, Homo sapiens
  misc_feature: GZ8MTXP02I27CD.45.79.H02.1.454.CMB.2.raw
  modified_base (302)..(302): a, c, t, g, unknown or other
  misc_feature (302)..(302): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcacccaggcaaacgcccccaaaactcatgatttangaggcagtaagccgcctgacgggtttctaatcgtcttctctgctccagtcnggcaacncggcctcctgacatctcgtggctccaggtctgagcgaggctgtattagtacngctgntcatatgctaggtagtaagtcgtttggtcgttcgggacgggaggacctaaaggtcctacggtaccgttaccgaggttaccgaacgtaccccgaagggcccttacggccccccgtggtcctaacccg

SEQ ID NO: 315463 - DNA, 616 bp, Homo sapiens
  misc_feature: GZ8MTXP02JBPEA.45.79.H02.1.454.CMB.2.raw
  modified_base (306)..(306): a, c, t, g, unknown or other
  misc_feature (306)..(306): n is a, c, g, or t
tcagacgcgatcgacacgaccggtgctcgatttagtgtcacacgaagggaaagggggggtcacaagaggcagcgctctcgggacggtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatgttgggattataaccttgtctctgtaccaacagcacccaggccaaacgcccccaaactcatgtatttagngaggcagtaacggccgccctagtagggtttctaatccgtcttcctctcggctaccagtcctgccaaccgaccggccctccgtcgaacacttctcgcgggtcctcgacggtctggagacgaggtctgaactttgttactgaccgtgtactctagtatcggatagggttattaacggttacgtttgggcggtttacgggacggggacgggtaaaccgtaagggccttacggttcccgtaaccggttggtaacccggaacggtaccccgtaaagggtccctacccggtcccccgtcgggtacctttaaccccg

SEQ ID NO: 315464 - DNA, 511 bp, Homo sapiens
  misc_feature: GZ8MTXP02FGX4Y.45.79.H02.1.454.CMB.2.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctggtaccaacngcaccaggcaaagccccaaatcatgatttangaggcagtaagcggccctgaggggtttcaatcgtcttcctctgctccaagtctggcaacgacggctccctgacactctcgtgggctccgaggctgaggcgaggctgattatactgctgctcgatatgactaggtagtagtacgttggtgttcggcggaggaccaaggctcgaccgtccgagtcaacgccaaggcctcgccccgtcggtctacc

SEQ ID NO: 315465 - DNA, 550 bp, Homo sapiens
  misc_feature: GZ8MTXP02F0HWF.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctgtaccanagcaccagcaaacgccccaaatcatgatttangaggcagtaagcgcctgtagggttactatcgcttctctgctcagtctgcacncgcctcctgacatctctggctcgagctgaggacgagctagattatacgtgctgctcatatgacgtaggtagttacgttagtttgggtcggttacgggacgggtaagggtaccgaacggtcgtacggtacccgttaccgtacgggttaccaacggtacccgaaacgggtcccgtcccggtcccccgttacggtcccttacccg

SEQ ID NO: 315466 - DNA, 547 bp, Homo sapiens
  misc_feature: GZ8MTXP02JU39M.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattataccttgtctctgtacangcaccagacaacgccccaaancatgtatttangaggcagaagcgcctgtagggttcaatcgtcttcctctgctaccagtcgngcacgacgtcctctagactactctcgtggcctacgaggctaggaggacgaggctagtacttactacngtctgtctactattagtgacgttagggttacgttacggttagttttgggtacggtcgggtacgggacggacgacggtccgtacgtacccgtcgtaggtccaaccgccgtaggccgttccgccccgtcgtcctaccg

SEQ ID NO: 315467 - DNA, 542 bp, Homo sapiens
  misc_feature: GZ8MTXP02JGBQA.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctcctggtaccaacagccaccaggcaaacgcccccaaactcatgatttatgaggcagtaagccggcctgagggtttctaagtcgcttcctctggctccagtctggcctaacacggtcctccctgacaactctcgtggctccgaggctgagacgaggctgattattactgctgctctatatgacgtaggtagttagttacgtttggtggttcgggacggtagggaccaaggctacggtaccgtaccgtaggtcaacgtccgtaacggccgtcgcccccgttcggtactaccg

SEQ ID NO: 315468 - DNA, 583 bp, Homo sapiens
  misc_feature: GZ8MTXP02IS0DS.45.79.H02.1.454.CMB.2.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (369)..(369): a, c, t, g, unknown or other
  misc_feature (369)..(369): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcctgggtctcctggacagtcgatcaccatctcctgcactggaaccngcagtgatgtggattataacttgtctctggtaccaangcaccaggacaaacgcccccaaactcatgtatttatgaggcaagtaacgccggccctgtacggggtttctaagtcgtcttcctcgtgctaccaagtctgctaacncggcctccctgacaatctcgtggctcgaggctgaggcgaagtctagacttagttactcgcttacgcttacagtaagtcgtactaggttacgtaagtttacgtttgggtagtttacggggacggacgggttaccaaaggtccgtcgtacccgtaccgttaacgggaccaacgacccgtaaaggtccgtaccgcccccgttacggtccctaaccgg

SEQ ID NO: 315469 - DNA, 539 bp, Homo sapiens
  misc_feature: GZ8MTXP02HS1P6.45.79.H02.1.454.CMB.2.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataacttgtctctgtaccaacagcacccaggcaaacgccccaaactcatgtattangaggcagtaagcgccctgtagggttcagtcgtcttcctctgctcaagtctggcaacgacgccctcctgacaatctctggactccgagctcgaggacgagctgatttattcgtgttgccttanatangacgacggacagtcgtaggttgggtcgtacgggacggacggtacgtacggtccgaccgtacgtacggtaccgacgaaccgacggtcccgtccgtaccccgtcgtacctaccgtccg

SEQ ID NO: 315470 - DNA, 552 bp, Homo sapiens
  misc_feature: GZ8MTXP02JFSI7.45.79.H02.1.454.CMB.2.raw
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctcctggtaccaacngcacccaggcaaacgcccccaaactcatgatttangaggcagtaagcggcctgagggttctaatcgcttctctggctccgaagtctggccaacacggcctccctgacaatctcgtggctcgaggctgagacgagctgattattacngctgctctatangcaggttagtagttacgtttgggtggttcggcgggtacgggacctaacggctacggtacccgtcgtaaggtcgaacggacccgaacgggtcctaccggtccccccgttacggtacctttaccccgg

SEQ ID NO: 315471 - DNA, 558 bp, Homo sapiens
  misc_feature: GZ8MTXP02J5LCU.45.79.H02.1.454.CMB.2.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagacgcgatcgacacgaccggtgctcgatttagtgtcacacgaagggaaaggggtttcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccagcagtnatcgttgggattatacctgtctctggaccanagcacccaggcaaacgccccctaaatcagtgatttangagggcaagtcgcgcctcgttggtgttancgtcttcctctgcacntacgtggcaaaccncggtcctcctacacancgtctcgcggcaaccgggngtgaggacgngtgtacttatattntacgtctntcnctaactntggtacgtagtaggttaacggtttagttacggtttacgggttcggtacggtacggtacgacggtacgtactaccgtaccgtcgtaccgtcgtacgacgtccgacccgtccgtccgtccgtccg

SEQ ID NO: 315472 - DNA, 582 bp, Homo sapiens
  misc_feature: GZ8MTXP02FXJPT.45.79.H02.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatggtgggattatacttgtctctgtaccangcaccagacaaacgccccaaancatgtattntggaggacagtaagccggcctgtagggttactaagtcgtcttcctctggactacgtaagtcgtagccaacgaccggtccctaccctagaacaacttctacgtgggtcctcgaggctaggacggaccgaggtctagtattacttacgtctctcgtctacgtattactcgtagtaaggttaggttacgtttacgtttggggtacggttacgggacggtacggggaacctaaggtcgtacgaccgttacgcgtacgaacgacccgaaggtccgtcccgtcccgtcgtctaccg

SEQ ID NO: 315473 - DNA, 580 bp, Homo sapiens
  misc_feature: GZ8MTXP02FXSQM.45.79.H02.1.454.CMB.2.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (260)..(261): a, c, t, g, unknown or other
  misc_feature (260)..(261): n is a, c, g, or t
  modified_base (291)..(291): a, c, t, g, unknown or other
  misc_feature (291)..(291): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacngtcgatcaccatcctcctgcactggaaccngcagtgatgttggattatacttgtctctgtacaanncaccagacaacgccccaaatcatgtattangaggcagtaacgcggccctgtagggtttactaatcgtcttccctctcggtctaccgtaagtctcggccaaaccacggccctccctagaactaactctcgtcggcctcgaggctaggagacgagctagtattattactgtctacgtctacattagtgacgtaaggttacgttaagtttcggtttagggttgggttcgggtacggggtacggaacccgtaagtccgtacggtacccgtacgttaggtccgaacgacccgaacggtcctaccgtcccctcggtccttacccg

SEQ ID NO: 315474 - DNA, 490 bp, Homo sapiens
  misc_feature: GZ8MTXP02HW5YC.45.79.H02.1.454.CMB.2.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacatcgatcaccatctcctgcatgaaccngcagtgatgtggattatactgtctcngtaccaangcacccagcaaacgccccaaatcatgtattangaggcaagtancgctnggtatancgntcntgcncgatctgcaactacgcctcctagaacactctctggcnccaggcgngagagagngtgtatatatgtctntntanatatgtagtagtagtagttagttgtgtggacggacggacgacgacgtacgtacgtacgtacgacgaacgacgacgcgtccgtcccgtccgtactcg

SEQ ID NO: 315475 - DNA, 550 bp, Homo sapiens
  misc_feature: GZ8MTXP02GT6PX.45.79.H02.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattataaccttgtctcctggtaccaacagcacccaggacaaacgccccaaatcatgatttangaggcagtaagcggccctcgaggggttctaatcgtcttcctctggctcaagtctggcaacacggcctccgtnacaatctctggctcaggctgagcgagcngtatattacngctgctcatangactaggttaagtagttacgttggtagttccgggacgggacggaccgaaagtcgtacgtacccggtacgtacggttacaacggaccccgaacgggtccctccggtcccccgttcggtccttacccg

SEQ ID NO: 315476 - DNA, 586 bp, Homo sapiens
  misc_feature: GZ8MTXP02G144I.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggtggattataaccttgtctctggtacacngcacccaggcaaacgcccccaaatcatgatttatgaggcaggtaagcggccctcgtaggggtttctaagtcgtcttcctcgtgctaccaagtctgctaacgacggcctccgagacactctcgnggctcaggctgaggcgaggctagtattattacgngctgcctnatatcgatagggttagtagttacgtttgggtcgttacggggaccgggtaagggggtaccctaaagggtccgttacggtacccggttacccgtagggttaccaacggtacccccgaaaggtcccttcccggtccccccgttacgggtcttaacccccg

SEQ ID NO: 315477 - DNA, 517 bp, Homo sapiens
  misc_feature: GZ8MTXP02JL7I7.45.79.H02.1.454.CMB.2.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagacgcgatcgacacgaccggtgctcgatttagtgtcacacgaaggggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattatactgtctctgtacangcaccagacaacgccccaaactcatgatttangaggcagtagcgcctgtagggtttctatcgcttctctgctcagtctgcaacgcgcctcctgactatctacgtggctccgaggtcngaggacgaggctagtattaattcngtntgcttanatncgtagaggttagtagttgttggtcggtacggacggacggacgtacgtcgtacgtaccgtacgtacgtcgaacgccgtacggtcctccgtcccgtcgtacctcg

SEQ ID NO: 315478 - DNA, 642 bp, Homo sapiens
  misc_feature: GZ8MTXP02IP8IF.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatggttgggattactaacttgtctctggtaccaacagcaccaggacaaacgcccccaaactcatgtatttatgaggacagtaacgcggtccctcgtacggggtttactaatcgtcttcctcgtgcctacaagtctggccaaccgacggccctcctacgaactaactcctacgtcggcctccgaggtctcgggaacggtacggaggtacctaggtatttaacttacgtcgtcgtcgtcttactattagtgtacgtaaggttacgttacggtttacgtttggggttcgttccgggggtacgggtaaccgggtaacgaaccggtacgttaccggtacccggttacgtaccgggttacaaccggtaccgtaaccgggtcccgcccggtacccccgtccggttaccgttccccg

SEQ ID NO: 315479 - DNA, 521 bp, Homo sapiens
  misc_feature: GZ8MTXP02HNAJH.45.79.H02.1.454.CMB.2.raw
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtaccangcaccagcaaacgccccaaactcatgatttatgaggcagtaagcgcctgagggttctatcncttcnctgctcagtctgcaacncgcctccngacatcncgtgctcagctgagacgngctgattatacgtgtctgctcatactgagtagtagtagttcgttggtgtcggtacgggaggtacctaaggtcgtacggtacccgtacgtaccgtacgaaccggacccgaacggtccctaccggccccctacggttacttccccg

SEQ ID NO: 315480 - DNA, 589 bp, Homo sapiens
  misc_feature: GZ8MTXP02H9I9T.45.79.H02.1.454.CMB.2.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (450)..(450): a, c, t, g, unknown or other
  misc_feature (450)..(450): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccntctcctgccactggaaccngcagtgatggttgggattataacttgtcttcctaggtaccaacagccaccgaggaccaaacgcccccaaactcatgtatttangaggnaagtaacgccggtcccgtacgtacggggtttactaatcgtcttcctcgtgcctacagtctgggcaacgaccgccctcctgacaatcctcgtgggtcctcgacggctagacggacgaggtctagtattactactcgntcgtctctatatgacgtaggttagttacgttagttttggtggttacgggtcgggacggtaccgaggtaccgtacgtacccgtccgttaacggtcgaaccggtaccgaacggtcctccgtcccccgttgtaccctacccg

SEQ ID NO: 315481 - DNA, 760 bp, Homo sapiens
  misc_feature: GZ8MTXP02HLUZ7.45.79.H02.1.454.CMB.2.raw
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccctgtctggtctccgtggacagtcgatccaccactcccctgcactgactccagcggtgtacgtttattgtttttaagntcgtctcctggtatcagcaacaccagcaaacgcccaatcatcatttangatgtacaataacgtccgtcctgtacggttctctatcgtccttcgtcgtcgtctacgtaacgttcgtcggaactaacgtacccggtccccttaccccgtacgtaacccttcgtccgttccggttccgggcccttaccgggtacggtacgttaacggaaacgggacggtaacgggtccgtttaaggtaacctttaaacgtttaaaccgttggacccttaacggaccttaagtaaacctttaaacgtttaagttttaacgggtttaccgttttacccggtaacgggttttaccggggttacggttaccgggggtaacccgggtacggggtaaaccgtttaacgggttaccggtaacccgttaccggtttaacgggacccgtaaaccggtaacccccggtaacgggttccccgtacccccggttccccgtaaccgggttaccccttaccgttttcccccgg

SEQ ID NO: 315482 - DNA, 548 bp, Homo sapiens
  misc_feature: GZ8MTXP02F7ZF5.45.79.H02.1.454.CMB.2.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (374)..(374): a, c, t, g, unknown or other
  misc_feature (374)..(374): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattataacttgtctctgtaccaacngcacccaggcaaacgccccaaatcatgatttangaggcagtaagcggcctgtaggggtttctaagtcgtcttcctctgctcaagtctgcacacggcctcctgacatctcnggctcagctgagacgagctgattattatgcttgctacatatcgacgtaggtacttagttacgttgggttcgttacgggtcgggaacgggtaccaaagtcgtacgacccgttaccgtaggttacgaaccggacccgtaaacggtccctccggtcccccgtacggtccttacccgg

SEQ ID NO: 315483 - DNA, 552 bp, Homo sapiens
  misc_feature: GZ8MTXP02G65F0.45.79.H02.1.454.CMB.2.raw
  modified_base (266)..(266): a, c, t, g, unknown or other
  misc_feature (266)..(266): n is a, c, g, or t
  modified_base (427)..(427): a, c, t, g, unknown or other
  misc_feature (427)..(427): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctctggtaccacancacccaggcaaacgccccaaactcatgatttatgaggcaagtaagcgcctcgtaggggtttctaatcgcttccctctcggctccaagtcgtgccaacgacggccctcctgacaatctctggctccgaggctgaggacgaggtctgtattattatgctgctntatatcgagtaggtagtagttacgtttgggtcggttcgggtacgggacgggaccaacggtcgtacgtaccggtccgtaacggtcaacggtcccgaacggcctccgcccccgtacggtcctacccg

SEQ ID NO: 315484 - DNA, 642 bp, Homo sapiens
  misc_feature: GZ8MTXP02GVV4B.45.79.H02.1.454.CMB.2.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (614)..(614): a, c, t, g, unknown or other
  misc_feature (614)..(614): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctcctgcactggaaccngcagtgagtggttgggattataacttgtctctgtaccaacngcaccagacaaacgccccaaatcatgtattagngaggnagtacgcgcctgtacgggtttactaacgtcgtctttccgtcgtcggtcctaccgtaacgtcgtcgggaccaaccgaccggtcccctacccgtagaactaactccgtcgtcgggcccttacgacggcgttaggacgggacggagtacttagtagtttacttacgtcggtctcgtctactagttagtcgacgttagggttaagttacggttacgtttaggggttacgggttcggggtacgggtacggggtaaccaaggtccgtacggtacccgttaccgtaggtcgaaccgcccggtaaacgggtcccnccggtcccccgttcggttacctaccccg

SEQ ID NO: 315485 - DNA, 588 bp, Homo sapiens
  misc_feature: GZ8MTXP02HL0Z0.45.79.H02.1.454.CMB.2.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (450)..(450): a, c, t, g, unknown or other
  misc_feature (450)..(450): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaacagcagtgatggttggattataccttgctctgtacaacagcaccaggacaaaccgccccaaactcatgtatttanggaggacagtaagccggtcctgtagggttctaancgtcttctactgctcgaattcgngaccaaacnccggtcctcccgagacattctcgtcggctacgngacgtgaggacgacgtcgtagtaacgttattaaccgtgtcttacgtctaccgtntaagtggtacgtaagggttaacggtttagttaccggttttagggttcggtacggggacgggtaaacggacgtaacgtcgtacgtaccgtaccgtacgtacgaaccgacgtacggcctccgccccgtacggtctacccg

SEQ ID NO: 315486 - DNA, 542 bp, Homo sapiens
  misc_feature: GZ8MTXP02HVJ7R.45.79.H02.1.454.CMB.2.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattatactgtctctgaccanagcaccagcaaacgccccaaactcatgattangaggnagaagcgcctgaggttctatcgtcttctctgctcagtctgccaacgacgcctccctagactactctcgtcgggcctccgacggtcgtggacggacggaggcgtagtatttattacgtgactgtctactatatacgcaacggcacgacagtcgacttcgttaggttaggttcgggacgggacggaaccaacggccgtaacggcccgtacgtaacgggtaccaccggtacccgaggtccctccccgg

SEQ ID NO: 315487 - DNA, 581 bp, Homo sapiens
  misc_feature: GZ8MTXP02GML2S.45.79.H02.1.454.CMB.2.raw
  modified_base (261)..(261): a, c, t, g, unknown or other
  misc_feature (261)..(261): n is a, c, g, or t
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtaccanagcacccaggcaaagccccaaatcatgattatgaggcagtagcgcctcgagggtttctaatcgtcttcctctggctcaagtctggcacacgcctccngacatctcgtcggctcgaggctgaggacgnggctaggtaatttatacgtcgcttgctactaatatgactaaggttacgttaagttcgtttggtggttccggggtacggacgggtaacccgaaaggtccgttaccggtaaccggttcccgtaaaggggtcctaaccggccccgtaaaacggggtccctacccggtaccccccgttcgggttcccttaaccccgg

SEQ ID NO: 315488 - DNA, 575 bp, Homo sapiens
  misc_feature: GZ8MTXP02GWR0I.45.79.H02.1.454.CMB.2.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (447)..(447): a, c, t, g, unknown or other
  misc_feature (447)..(447): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccatcctcctgccacgtggaaccagcagtgattggttaggggattactaacttgtctctggtaccangccaccagacaaacgccccaaancantattangaggcagtagcgcctgaggttctatcgtctcctgtgtctcagtctggcacgcgcctccagacatctcgtggcctcccgaggcgtagacggacgacggacgttagtaagtttaacttagtcgtcgtacgtcttactagttacnggtactagggttacgttagttacgtttgggtcgttaccgggacgggtacgggacaacggtccgtacggtacccgtacgtggtaccgaacggcccgaacggttcgcccggtcccccgtggtcctacccg

SEQ ID NO: 315489 - DNA, 559 bp, Homo sapiens
  misc_feature: GZ8MTXP02GIAOR.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataccttgtctctgtaccaangcacccagcaaacgccccaaactcatgatttatgaggcagtaacgcggcctcgaggggtttctaatcgtcttcctctgctcagtctgcaacncggcctcctcgacatctcgtggctccaggctgacgacgaggtctagtacttattactgtctgtactctatagtcgacgtaggtttagtacggtttacgtttgggtaggttcgggtacgggtacggacgtaacgccgtacggacccgttacgtacggtacgaaccgaccgaacggtccgtcccgtccccgtcgtaccgtacccg

SEQ ID NO: 315490 - DNA, 660 bp, Homo sapiens
  misc_feature: GZ8MTXP02GPPQQ.45.79.H02.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcatcctgcctccgtgtcgtggtctcctggacagtcgatcaccatctcctgcactggaaccagcagtgatgttggattataacttgtctctgtacaacngcaccagacaaacgaccccaatcatgtatttagngaggcaggtaagccgccctgtagggtttctaagtcgtcttcctctcgtcctacgtaagtccgtaggccaaccgaccggtccctccctagacctaacttcctcgtacgggtctacccgaggtccgtaggaacggacgggacggtattaggtaacttacgtttaacgtcgtcttcgtcttaacgtaattagtaccggtagtaagggttagttaaaggtttcggtttttggggtcgggttacggggtaacggggacggtaccggtaaacggtcgttaaccggtacccgttaccggtacggttacccgaacgggcccctaaacggggtccctccccggtacccccgttccgggtacttaaccccgg

SEQ ID NO: 315491 - DNA, 504 bp, Homo sapiens
  misc_feature: GZ8MTXP02FUGBU.45.79.H02.1.454.CMB.2.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcatcaccatctcctgcactggaaccngcagtgatgtggattanacttgctctgtacangcaccagcaaagccccaaatcatgatttangaggcagtaagcgcctgtagggttcaatcgtcttcctctgctacagtctggccaacacggctccctagacatcncgtggctccaggctgaggacgagctagattattactgntgtcctanatngagtagtagtattgttggtcgtcggacggacggacgacgtcgtacgtaccgtcgtacgacgaacgaccgacgccgccgtacccgtcgtactccg

SEQ ID NO: 315492 - DNA, 684 bp, Homo sapiens
  misc_feature: GZ8MTXP02GF9UN.45.79.H02.1.454.CMB.2.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtccctcgtgacngtcatccacctatcctctgcacgtacggaaccngctagtgtagttggttaggtattaacttacgttcgtcctcgtacgtaaccaacncgacccaccgacgaaccaaacccgacccctaactctatagttatttagacggacggacgtaaggtaccggcccgtaccgtacggttacggttacacgtcgtcttccgtcgtcgtcctacgtacgtcgacgaccaccgtccgtccctaccgagaacctacttccgtcggtcggtccctacgacggtcgtagggacgggacggtacgtacgtagttaacttacgttacgtcgtacgtcgtacctactaagttcgtacgtacggttaagggttacgtttacggtttacggtttcgggttacgggttaccgggaacgggtacggaccgtacggtccgtaccggtaccgttacggtacgaccgaaccgtaccggtacgtcccgtccccgtcccgtcgtacctccg

SEQ ID NO: 315493 - DNA, 654 bp, Homo sapiens
  misc_feature: GZ8MTXP02JDUHH.45.79.H02.1.454.CMB.2.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattactacttgtctctgtacacncncaccagacaacaccccaatnatntattagagaganagtacgcgccgtgtacggttactagtcgtcttcctcgtcgtctactagtcgacgcaacgcgcctcctagactactcgtcgtcggtcctcgaggcgtaggacggacgaggtacgtagtacttacgttactcgacgttcgtacttacgtaagttacgtacggtacggtaagggttaacgtttaacggtttacggttttagggttacggggttaccgggggtaacgggtaaacggggtaaccgtaacggtaccggttaaccgggtaacccgtttaccggtacgggtaaccgaaccggtaacccggtaaaccgggtcccgttacccgggtacccccggttacggtacccgtttaccg

SEQ ID NO: 315494 - DNA, 578 bp, Homo sapiens
  misc_feature: GZ8MTXP02IMQV8.45.79.H02.1.454.CMB.2.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattataacttgtctctggtaccaangcacccaggccaaacgcccccaaactcatgaatttatggaaggcaaggtaagccggccctgtaggggtttctaatcgtcttcctctggcctccaagttctggccaacgaccggcccttcccagacaactctcgtggcctcaggctagacgacgagctgtattattactgcttgctctatatgacgtaggttagttaggttacgtttgggtgttacggggtacgggacgggtacctaaggttcgaccggttacgtacggtcgacggtaaccgtaacggccttacccggccccgttcggtacctacgttcccg

SEQ ID NO: 315495 - DNA, 532 bp, Homo sapiens
  misc_feature: GZ8MTXP02JNB3M.45.79.H02.1.454.CMB.2.raw
  modified_base (226)..(226): a, c, t, g, unknown or other
  misc_feature (226)..(226): n is a, c, g, or t
  modified_base (264)..(265): a, c, t, g, unknown or other
  misc_feature (264)..(265): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattataactgtctctgtacacnncaccaggcaacgccccaaactcatgatttangaggnagtaagccgcctgtagggtttactatcgtctcctctgctcagtctgcaacncggtcctcctgacatctncggctcgagctgagacgngtcngtattattatgtactgctcgatactgcgtaggttagtacgttacgtttgggtcgttcggggtacggacgggacacggtcgtacggtaccgtcgtacggtacaacggcccaacggtcgtccgccccgttcggtcctacccg

SEQ ID NO: 315496 - DNA, 572 bp, Homo sapiens
  misc_feature: GZ8MTXP02IOHIU.45.79.H02.1.454.CMB.2.raw
  modified_base (226)..(226): a, c, t, g, unknown or other
  misc_feature (226)..(226): n is a, c, g, or t
  modified_base (468)..(468): a, c, t, g, unknown or other
  misc_feature (468)..(468): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttgggattactaacttgtctctggtaccaacagcacccaggaccaaacgacccccaaactcatacgtatttatggaggctaaggtaacgccggtcctcgtaggggtttactaagtccgtcttcctcgtcggcctctaagtcctaggccaaacgcggtaccctcccgtagacaactctcgtcggcctcgagctggacggacgagctagattaatcgtgcctgtcctatatagngtacgtaggttaagtagttacgtttgggtgtcgggtacggagggtacacgtcgacgtacccgtcttacggcaacgtccaacggtctccgcccctcggtcctccg

SEQ ID NO: 315497 - DNA, 575 bp, Homo sapiens
  misc_feature: GZ8MTXP02IES7U.45.79.H02.1.454.CMB.2.raw
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataacttgtctcctgtaccaacagcacccaggcaaacgccccaaactcatgatttatgaggcagtaagcgcctcgaggggtttctaatcgcttcctctggctccaagtctggcaaacgacggcctccctagacaaatctctgggctccgnggctgaggacgagctgattattacngactgtctcatagtgacgtaggtacgttagttaacgtttgggtcgttacgggtacgggagggaccgtaacggacgttacggtaaccccgttccgtaacggttaccgaacggtaccccgaaagggcccctaccggcccccgttccgggtacctaccccg

SEQ ID NO: 315498 - DNA, 728 bp, Homo sapiens
  misc_feature: GZ8MTXP02HOET3.45.79.H02.1.454.CMB.2.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatggttggattataacttgtctctagtaccacagcaccagcaaacgccccaaactcatgtatttagngaggcagtaagccggtcctgtaggggtttactaagtccgtactttccctcgtcggtcttaccaaggttccttacgggaccaaaccgtaccggtccccttacccgtacgaacctaacgttcccgtacgttcgggtcccttacccgaacgggtccctgggaaacgggaccggtaaggtccgtaggttatttaacgtttacgtggttacctttcgtactttacaagtttatacggtacgttaagggtttaacgtttaaggtttaccggttttgggggttcggtttaaccggggtacgggggaaaccggggttaaccaaacggtcggttaaccgtccccgggttacccgtttaaaggggtccctaacggacccccgttaaacggccccgttaccccggtcccccccgtttcggggtttaccttaccccccgg

SEQ ID NO: 315499 - DNA, 565 bp, Homo sapiens
  misc_feature: GZ8MTXP02IYZ88.45.79.H02.1.454.CMB.2.raw
  modified_base (224)..(224): a, c, t, g, unknown or other
  misc_feature (224)..(224): n is a, c, g, or t
  modified_base (263)..(264): a, c, t, g, unknown or other
  misc_feature (263)..(264): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctcctgcactggaaccngcagtgatggttggattataacttgtctctggtaccaanncaccaggacaaacgcccccaaactcactgtatttatggaggcaaggtaagccgcctgtagggtttctaatcgtcttcctcgtgtctacaagtctggcaacgacggcctccagacaatctacgtggcctcgnggctgacggaccgagtctagatttagtactcgtntcgtctactagtancgacgtaggtacgtttaagtcgtttgggtcgtttcgggacggtacggaccaaggtcctacggacccgttacgttacggcgaacggtacccgaacggtcctccgccccgtcggtccctacccg

SEQ ID NO: 315500 - DNA, 735 bp, Homo sapiens
  misc_feature: GZ8MTXP02JBHP4.45.79.H02.1.454.CMB.2.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtaccacngcaccagacaaacgccccaaatcatgatttangaggcaggtagccggcctacgtagggtttctaatcgtcttcctcgtgcctaccgtagtccgtaggaccaaccgtacccgggtccctaccccgtagaacctaaacttcccgtccgttacggggacccttacccgagggtacccgttagggaacggggtaccggtaaggggtccttagggtaaacttttaacgtttaaccgttcggggtccttacggtcccttaacaaacgtttagtaccgggtaccgttaaaggggtttaggtttaacgtttaccggttttgggggtacggtttaccggggaccgggggtaaaacgggtacccgtaaacgggttccgtaacccgggtacccgtttacccggtaacggtacccgaaccggtacccccggtaaagggtcccccgttaccccggtaccccccggttacggtaccccttaaccccg

SEQ ID NO: 315501 - DNA, 547 bp, Homo sapiens
  misc_feature: GZ8MTXP02IFRAS.45.79.H02.1.454.CMB.2.raw
  modified_base (226)..(226): a, c, t, g, unknown or other
  misc_feature (226)..(226): n is a, c, g, or t
  modified_base (309)..(309): a, c, t, g, unknown or other
  misc_feature (309)..(309): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggagttataaccttgtctcctggtaccaacagcacccaggacaaacgcccccaaactcatcgaatttangaggcagtaacgcggccctgaggggtttctaatcgtcttcctctgctccaagtctgcaacacggcctcctgacatctcgtggcctcagctgagacgagctgattntactgctgctacatagngacgtaggtagttaagttcgtttggtggttcggacggagggtaccctaaagccgtacgtacccgtacgtacggtcaacgacccgaaggtcctaccggccccctcgggtcctacccg

SEQ ID NO: 315502 - DNA, 600 bp, Homo sapiens
  misc_feature: GZ8MTXP02I8LFP.45.79.H02.1.454.CMB.2.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (576)..(576): a, c, t, g, unknown or other
  misc_feature (576)..(576): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgatggttgggattataaccttgtctcctgtaccaangacacccaggaccaaacgcccccaaatcatgatttangaggcaggtagccgcctgtagggttactaatcgtcttccctacgtcgctaccaagttcgtcgccaaaccgccggtccctccccgtagaaccaactccgtcgtgggtcctacgacggactaggacggacgacggtctagtaatttagttaacctggccttagccttacaatgttacgagtaggttaagtagtttacggtttgggtggtcggtacgggtacgggaccaaggtcgtacggtacccgtcgaacggtcgaaccgtacccgaacggtccncccgtcccccgtggtaccttcccg

SEQ ID NO: 315503 - DNA, 609 bp, Homo sapiens
  misc_feature: GZ8MTXP02ITF83.45.79.H02.1.454.CMB.2.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccntctcctgcactggaaccngcagtgatggttggattataacttgtctctgtaccaacngcaccaggacaaacgcccccaaactcatgtatttangaggcagtaagccgcctgagggtttctaatcgtcttcctctcggctaccaagtcctggcaacgaccggccctcccctgaacaacttcctacgtcgggccttccgaaggctaggacggaccgagcctagaatttattacgtcgcttggtctactatagtcgacgtaagggttagttaacgtttacgtttggggtcgtttcggggacgggtaacggggtacccaaaggtccgttacggacccgttaccgtaacggttccgaacgtaccccgaaaggtccctaccggtaccccccgttcggtaccttacccg

SEQ ID NO: 315504 - DNA, 766 bp, Homo sapiens
  misc_feature: GZ8MTXP02JCI00.45.79.H02.1.454.CMB.2.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctnacagacgacnagtgtgtgttggtaggtattactacgttntcctcgtacgaacagcaccacgcgaacaaccccgaaccctaactgtatattagaggacgtacctaacgtacggcccgtaccgtagggtacggtctaatacgtcgttcttccgtcgtccaccctaacggacgggccgaaacaccggtccgttcccgttcggtacggtccgttctcgggtactacccacggacgtcgaagggaacggacgggtactcggtaatttaactttaacgtcgacgttacgtcgttacctaaacggttattacgggtaccgaaacgttttaaagggttcgggaacctaaaaccccgtttcggtttcggggtttaggggtttcccgggggacccgggggtaaacgggggtaacccgtttaaaaccggtttacgggggtacccccgttaaaccccggttacggggttaacggacccggaaacccccgaaacggggtaccccggttccgtaccccccccggttcccggtttaacggtaccccttaccggttttccccccggg

SEQ ID NO: 315505 - DNA, 535 bp, Homo sapiens
  misc_feature: GZ8MTXP02F2UXW.45.79.H02.1.454.CMB.2.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (434)..(434): a, c, t, g, unknown or other
  misc_feature (434)..(434): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatgttgggattataaccttgtctctgtaccaangcacccaggcaaacgcccccaaatcatgatttatgaggcaggtaacgccggccctcgtaggggtttcaatccgcttcctctgctccaagtctgggcaacacggcctcctgacaatctctgggcctcgaggctggagacgaggctagattattactgcttgctctatatgngtaggtagtaagttcgtttggtgttcgggcggtacgggacaacggtctcggacccgttcgagtacgaacgaccgtaaggcctcggccccctcggactcccg

SEQ ID NO: 315506 - DNA, 520 bp, Homo sapiens
  misc_feature: GZ8MTXP02FPVCZ.45.79.H02.1.454.CMB.2.raw
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgtcctgactcagcctgcctccgtgtctggtctcctggacagtcgatcaccatctcctgcactggaaccagcagtgatggttgggattataaccttgtctcctggtaccaacngcacccaggcaaacgcccccaaatcatgatttangaggcagtaacgcgcctgagggtttctaagtcgcttcctctgctcagtctgcaacacgcctccgtgacactctctcgggcctccgaggtctaggaggacgagggctgtattagttactgctgctcatangcaggtntagtattggtgttcggacggtgggaccaagctacgaccgtacgagtacaacgccgaagccgttccgccccgtcggtctaccg

SEQ ID NO: 315507 - DNA, 560 bp, Homo sapiens
  misc_feature: GZ8MTXP02GKMPL.45.79.H02.1.454.CMB.2.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
  modified_base (410)..(410): a, c, t, g, unknown or other
  misc_feature (410)..(410): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaccanagtgattggttgggtatttttagtttgtctctggtaccaacacacccgcgaacgccccaaatatcattanaggacactaagcggcctcggggttcagtcgcttctctgctcaagtctcggcaacacggcctcctagacatcctcgtcgggctccgaggctcgagacgagctgatttattcgngttgcttcatagtgacagggaccagctacgttgggtcgttcgggcggtacggaccgtagggttcgaacccggtctacggcacgacccgaaggccctcgtcccccgtggtcccaactccgttaccgtcccccaccttcctactcggtaccg

SEQ ID NO: 315508 - DNA, 672 bp, Homo sapiens
  misc_feature: GZ8MTXP02GU1I7.45.79.H02.1.454.CMB.2.raw
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctcctgcacgtggaaccngcagtgatggtagggattactacttgtctcngtacangcaccagcaacgccccaaatcatgatttagngaggntagtacgccgtcctgtagggttactatcgtcttccgtcgtcggctaccgtaagtcttacgggactaacccgaccggtcccttacccgtactaacctaattccctcggtacggccctaccgagggtctacggggagggaccggaaggttccgtaggttaactttacgttacgtcggttcctcggttacctagtattagtccggtaaggttagggtaagtttaacggtttacggtttcggggtaggggttccgggacgggtaaacggggttaccaaacggttccgttaaccgggtccccgtttacgaaacggtccgaaccgtaaccccggtacggtccccggttacccgccccgttacggtaacccttcccgg

SEQ ID NO: 315509 - DNA, 573 bp, Homo sapiens
  misc_feature: GZ8MTXP02GE6IK.45.79.H02.1.454.CMB.2.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataacttgtctctgtaccaacagcaccagacaaacgccccaaatcatgattangaggcagtaagcgcctgtagggttctaagtcgtcttcctctgctaccgtaagtctggccaacgaccggtccctaccctgaactaactctcgtggcctaccgaggctggagacgagtctagattacttacgtgtctgctactatatcgagtaggttagttacgttacgtttgggtcggttcggacgggtaacggaactaacggtcgtacggtacccgttacgtaacgggtaccaacggacccgaaaggtccctcccgtcccccgtacggtacctcccg

SEQ ID NO: 315510 - DNA, 572 bp, Homo sapiens
  misc_feature: GZ8MTXP02JVFR4.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgagtggttgggattatacttgtctctgtaccangcaccaggacaaacgccccaaatcatgtatttangaggcaggtaacgccgcctgagggtttcaagtcgtcttccgtctggctcgagtcgngccaacacggtccctcctgacatctcgtcggctccgaggtctgacggacgnggtctagtattacgttacgtgtcgtcgtactcaattgtcgacggttaggttaggttaacgtttcgtttgggtcggttacggggacgggtacgggacctaacggtcgtacgtccgttacgtacgtacgtaaccgaccgacggtcctccgtccccgttcgactttcccg

SEQ ID NO: 315511 - DNA, 503 bp, Homo sapiens
  misc_feature: GZ8MTXP02GQKVN.45.79.H02.1.454.CMB.2.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgttgggattataaccttgtctctggtaccaacagcaccaggcaaacgcccccaaatcatgatttatgaggcagtaagcgcctnagggtttcaatcgcttctctgctccaagtctgcaacacggtcctcctgacatctctggctcgagctgagcgaggctgatattactgctgctcatatgcaggtagtagttactttggtgtttcggcggagggaccaagctcggaccgtccaggtcaacgcccgaaggtctccgccccctacggctaccg

SEQ ID NO: 315512 - DNA, 529 bp, Homo sapiens
  misc_feature: GZ8MTXP02FH4QH.45.79.H02.1.454.CMB.2.raw
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggattataaccttgtctcctggtaccaacagcacccaggcaaacgccccaaactcatgatttatgaggcagtaagcggcctcgtaggggtttcaatcgtctccctctggctcaagtctggcaacacgcctcctgacatctcnggctccgagctgagacgagctgattattacngctgctcatatgcgtaggtagtagttacgtttggtggttcgggcggtaggaccgtaaacgcgtacgaccgtcctacgggtcaacgcccaaacggctccgccccgtcggtctacccg

SEQ ID NO: 315513 - DNA, 558 bp, Homo sapiens
  misc_feature: GZ8MTXP02I2H2U.45.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (462)..(462): a, c, t, g, unknown or other
  misc_feature (462)..(462): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattgtgggattataacttgtctctggtacaacngccaccaggaccaaacgacccccaaactcatgtatttagngtaggcaggtaagccggtcctacgtagggtttactaagtcgtcttcctcgtcgctaccgaagtcctgcaaccgaccggtccctacccgtgaactactctcgtcggcctaccgaggctaggacggacgaggtctagtaattattacgtggtaatcctnattagagccagcagcagtcatcgtaagtcgtacggcggaggacaacgcgttacgacccgtaacgtaggaccacgacccacggcgtacccgtccccg

SEQ ID NO: 315514 - DNA, 576 bp, Homo sapiens
  misc_feature: GZ8MTXP02IW1VY.45.79.H02.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgccactggaaccngcagtgattggttggattataacttgtctctgtaccaacngcaccagcaaacgcccccaaatcatgatttngaggnagtaagccggccctcgtacggggtttactaactcgtcttccgtcgtggtcctctaagtctagggccaacgaccggcccttccccgtagactaactcctcgtcgggccttcccgagggtctgggacggaccgaggtcctaggtattatttacngtctgtcctagtatatcggntaagggttgtaagtttctttgggtgttacgggcggacgtaccaaggtcacggaccttaccggagtacaacgaccgaggccctccggtcccctcggtacctcg

SEQ ID NO: 315515 - DNA, 605 bp, Homo sapiens
  misc_feature: GZ8MTXP02F98MD.45.79.H02.1.454.CMB.2.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (398)..(398): a, c, t, g, unknown or other
  misc_feature (398)..(398): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggattataacttgtctctgtaccaanagcaccaggacaaacgcccccaaatcatgtactttatggaggcagtaagcggccctgtagggttactaagtcgtcttcctcgtgctccaagtcgtggcctaacacggcctccctagacatctcgtggcctcgagntggacgacgaggctagtattacttacgtcgtgtcgtctactagttatcgtacgtaaggttaacgtttaggttaaccggttttggggtcgggttacggggtacggggaacgggtaaccgtaacggtaccgttacggtacccgttaccgtacggtaccaaccggtacccgaagggtccctacccggtcccccgtacggtcttaaccccg

SEQ ID NO: 315516 - DNA, 632 bp, Homo sapiens
  misc_feature: GZ8MTXP02H5L2S.45.79.H02.1.454.CMB.2.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttggattactacttgtctctgaccanacgcaccagacaacgacccaactnatgggtatttagaggaggacaaggtacgccggtccgtaggtagggtttactaactcgtcttcctcgtcgtctacgtagtcgtacggaccaaccgaccgtccctaccgtacgactaactcgtccgtcggcctaccgaggtcgaggacggacggacgtctagtatttagtactggtcttcgtctactagttacgtagaacgttaggttagttagtttacggttttgggtcgggttacgggtacgggaaacggtaccgtaacggtccggtacggtacccggttaccgttacggaaccgtaacggaccctaacggtcccgtaccggtcccccgtacggttacctcccg

SEQ ID NO: 315517 - DNA, 647 bp, Homo sapiens
  misc_feature: GZ8MTXP02HE4KI.45.79.H02.1.454.CMB.2.raw
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactaggaaccagcagtgagtggttaggagttactaaccttgtcctacctaggtaccaacagaccacccaggaccaaaccgacccctaaactcatgtatttagaggaggataggaacgccgtccgtagtacgggtttctaatcgtcttccgtcgtcgtcctacagtctacggactaccgaccggtccctaccgtacgaactactctcgtcggacctcgagtcgtagcggtacgagtctagtaattctacgtcgtactcgtcctatagtagacggtacgtaaggttagttaacggttttaccggttgggttacggttaccggggacggggtaaaacggaccgtaaacggtccgtacggtacccgttacgtaccggtacgaaccggtaaccgaccggtcccgtacccggtcccccgtcggtacccttcccgg

SEQ ID NO: 315518 - DNA, 692 bp, Homo sapiens
  misc_feature: GZ8MTXP02HX0OH.45.79.H02.1.454.CMB.2.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcatcaccatctcctgcactggaaaccngcagtgatggttggattataacttgtctctgtaccaanacgcaccagacaaaccgaccccaaactcatgtatttataggaggactaaggtaacgccggtacccgtacggtaggggtttactaacgtcgtcttccctcgtacggtcctaccgtaacggttcctagggcctaaaccgtccggtcccccttacccgtagaaacctaaacttcccgtcgtacggggacccttacccgaagggtcccgttgggaaacggggaccggacggtacgttaagtatttaaacgttacgttcgtcgtcgttctacgtacttacgtaggtactaaggggtttaacgtaggttttaaccgtttggggttaacgggttccgggacggggtaacggaacccgtaaagccgttacggacccggtaccacggtctaaccggacccgtaacggcctacccggccccgttcggtacctacccg

SEQ ID NO: 315519 - DNA, 565 bp, Homo sapiens
  misc_feature: GZ8MTXP02FT2QJ.45.79.H02.1.454.CMB.2.raw
  modified_base (227)..(227): a, c, t, g, unknown or other
  misc_feature (227)..(227): n is a, c, g, or t
  modified_base (265)..(266): a, c, t, g, unknown or other
  misc_feature (265)..(266): n is a, c, g, or t
  modified_base (371)..(371): a, c, t, g, unknown or other
  misc_feature (371)..(371): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtggaaccngcagtgatggttggattataacttgtctctgtaccaanncaccagacaaacgaccccaaatcatgtatttatgaggcaggtaagccggcctggtagggtttcaagtcgtcttctctgctcagtctcggctacgacgtcctccgngacactctcgtgggctcgagctggacggacgaggtctagtatttacgtactgctcgtatctagtatgacgtagggttagttaggttacgttgggttcggttacggacgggtacggaacgacggtcgtacgaccgttcgtacggtacgaaccggccgaacggtcccgtaccgtcccccggtacgtccttaacccg

SEQ ID NO: 315520 - DNA, 557 bp, Homo sapiens
  misc_feature: GZ8MTXP02HIW3N.45.79.H02.1.454.CMB.2.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatggactgcactggaaccaanagtgatgttgggatttttagtttgtctctgtaccaanaacacccgnaancccccaaataatcattataggacataagcgccctggggtttcaaagtcgacttcgtctaggtctccaaagtctacggccaaaacncggccttacccngaacaatctcngggctccaggctcagacgaggntntattattntgtgtctnatatgngagacgagctacgtggtggtcggcggacggacgtaggtacgtacgtacgtacgtacgacgaccgaacgacgtccgtcccgtccgtaccgtaaccgtcgtccgtcccgtcccgtcctccgtacgtcg

SEQ ID NO: 315521 - DNA, 658 bp, Homo sapiens
  misc_feature: GZ8MTXP02GVQNZ.45.79.H02.1.454.CMB.2.raw
  modified_base (227)..(227): a, c, t, g, unknown or other
  misc_feature (227)..(227): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngcagtgagttggttagggattataacttgtctctaggtaccaacagcaccaggaccaaacgaccccaaatcactgtaatttagaggaggacaaggtaacgccggtccctagtacgggtttactacgtcgtcttccgtcgtcgtctacgtaacgtcgtacggacctaaccgccggtccctacccgtacgtaacctaacgttccctcggttcgggacctccgaaacgggtccgtaggaacgggaacccgtggtaccgttagtactttacgttacgtcgtccgtagtcgtacctattacgtacgtaccgtaggttacgttaagtttacggtttcgggtcggttacgggacggtaacgggtacgtaaacgtcgtaccggtaccgtacgtacgacgaaccgaccgtacgggtcctcccgtcccgttcgtacctccg

SEQ ID NO: 315522 - DNA, 706 bp, Homo sapiens
  misc_feature: GZ8MTXP02JKB4S.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccatcctcctgcactggaaccngcagtgatggttgggattatacttgtctctgtaccanancaccagacaacgccccaatcatgtatttagngaggcagtaagccgcctgtaggttactagtcgtcttccgtcgtcggcctaccgtagtccgtcggacctaaccgaccggtcccctacccgtagaaccctaagttcccgtacgtccgggtccctcccggaacggtccgtagggacggacgggtaacggtcgtagtaacgtttaacttacgtgtccgtacgtaccttacgtaagttacgtaccgtaaggttaagggttaacggtttacggtttacggttttcgggggtttcgggtaccgggggtaaccgggggtaaacgggtaaacccggtacggttacccggtaaccgggtaccccggttaccggttaacggtaccgaacccggtacccggtaaccggtcccgtacccccggtcccccggtttaccgggtaccctttccccgg

SEQ ID NO: 315523 - DNA, 688 bp, Homo sapiens
  misc_feature: GZ8MTXP02HCEDN.45.79.H02.1.454.CMB.2.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccngcagtgatggtgggattatacttgtctctagtaccangcaccagacaaaccgccccaancatgtattagnggaggcaaggtaacgccggtcctaggtacgggtttactatccgtcttcccgtcgtcggtacctacgtaagtccgtcgggacctaaaccggtccggtccccttacccgtacgaacctaacgttcccgttcgtccggggtacccttaccggacgggtacgttacggggaacgggacccggtaagggtccgttagttaacgtttaacgttacgtggtcctttacgcttacgtaagttcgtacggtacgttaagggtttaagtttacggtttacggttttcgggttacggggtacgggtaacggggacggtaccgaaacggttcgtaccggtaccgtaccgtacggtaccgaaccgtccgaacggtcccgttcccgccccggttcggtactcccg

SEQ ID NO: 315524 - DNA, 556 bp, Homo sapiens
  misc_feature: GZ8MTXP02IMAH7.45.79.H02.1.454.CMB.2.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtggtcctccgtggacagtcgatcaccatcctctgcactggaaccngcagtgatggttggattactactgctctgtacanagcaccagacaacgccccaaatcatgtattangaggnagtagcgcctgtaggttactatcgcttctcgtgtctacagtcgtcgcacgaccgcctcccgtagtacactctcgtcggctcgagcgtagagacgagtcgtgtattattacgtgtctcgtactatactaagtcgtagtaggtagttagttaacgtttggtcggttcggcgggaacggtacgacgtccgtacggtaccgtaccgtacggtccgaacgtacccgaacggtcccgtccgacccccgttcggtacgtccccg

SEQ ID NO: 315525 - DNA, 572 bp, Homo sapiens
  misc_feature: GZ8MTXP02F36AL.45.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctctgtaccaangcaccagcaaacgcccccaaatcatnatttatgaggacaggtaagcggccctgtaggggtttactaagtcgtcttcctctggctaccaagtctggcaacgaccggtcctcccngaacaactctcgtgggcctccgaggtctgaggcgaagctagtattattactgctcgctcgattacgngtacgtagttaggttacgttacgtttagggtacggttcgggacgggtacgggaccgtaacgtcgtacggaccgttccgtaggtacgaacgcccgaaggtccgtaccgtccccgtcggtacctacccg

SEQ ID NO: 315526 - DNA, 498 bp, Homo sapiens
  misc_feature: GZ8MTXP02FU4RM.45.79.H02.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (365)..(365): a, c, t, g, unknown or other
  misc_feature (365)..(365): n is a, c, g, or t
  modified_base (472)..(472): a, c, t, g, unknown or other
  misc_feature (472)..(472): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattanaacttgtctctggtaccaangcacccagcaaagccccaaatcatgatttatgaggcagtaagcggcctcgaggggtttctaatcgtcttcctctggctccagtctggcacacggcctccngacatctctggctcaggctgaggcgaggctgattatactgctagctcatatgctaggtagtagttacgttggtagttcgggcgtagggaccagctgaccgtcagtcngaccaggcctcgcccgcggtctaccg

SEQ ID NO: 315527 - DNA, 533 bp, Homo sapiens
  misc_feature: GZ8MTXP02GS9ID.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggattataaccttgtctcctggtaccaacagcacccaggcaaagcccccaaactcatgatttatgaggcagtaagcggccctcaggggtttctaatcgtcttcctctggctcaagtctggcaacacggcctccctgacatctactggctcaggctgaggacgagctgattatactgctgctcatagtgactaggtagtagttacgtttgggtcgttcgggcggagggtaccaaaggtcgtacggaaccgttcgtaacggtcaacgtcccgaaggcctcgccccctcggtactcccg

SEQ ID NO: 315528 - DNA, 678 bp, Homo sapiens
  misc_feature: GZ8MTXP02HOB0L.45.79.H02.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactaggaaccngcagtgattggttggattactaacttgtctctcgtaccacacgacaccagacaaacgaccccaaactcatagtaatttagtaggaacggtacacggtaacggcccggtacccgtggtacggggtttacttaagtccgtctttcccgtccgtacgtcctaccgtagttccgacgccaaccgccgtaccctccctagtaactactccgtcgtcggtcctcgacgggctggaacggacgtaggctgttattacttacgtagtcttcgtacttacgtattacgtcgtacgttaagggttaacgtttacgggtttaggtttcggggttacggttaccgggggtaacggtaacggggtaaccgaacgggttaccgtaccgggtaccgttacccggtacggtaccggtaaccgacccggaacggtccgtaccccggtccccgtacggttaccctacccgg

SEQ ID NO: 315529 - DNA, 674 bp, Homo sapiens
  misc_feature: GZ8MTXP02H4CM0.45.79.H02.1.454.CMB.2.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtcctcccgganagtcgatcaccatctcctgcactggaaccngcagtgatggttggattataccttgtctctgtaccangcaccagacaaccgccccaactcatgatttanggaggacagtaacgccggtccctaggttacgggtttctaaatccggtcttcctccgtgtcctactaacgtctacggaccaccgccggtcccncccttacgacctatctcgtacgggctcccgagcgtagagacggacgtgtagtaactttaactcgttcgtcgttcgtaacccttatagtttaacggtacggttaacggttaagggtttaacggtttacgggtttaacgggttttcggggttacggggttaccgggggtaccggggtaaacggtaaccggtaaacggtccggttaccgggtaaccgttaccggtacggtaccgtaccggaacccgtacggtcccgtcccggtcccgttaccgtaccgtaccgttcccg

SEQ ID NO: 315530 - DNA, 563 bp, Homo sapiens
  misc_feature: GZ8MTXP02IISJJ.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatgtggattactaacttgtctctggaccaanagcaccagcaaacgccccaaatcatgatttataggaggcagtaagcggtcctgaggggtttctaagtcgcttcctctggctcaagtctgcacacggcctcctagactaatctcgtggccttcgagcgtagaggacgaggactgaattattactgtntacgtctactattacgngacgaaggttagtaacgttacgtttagggtcggtttacgggaggtacgggtaacgaagtcgtacggtaccgttaccgtaggtacaacggtaccgaaacggtcctaccggccccgtacggtactacccg

SEQ ID NO: 315531 - DNA, 607 bp, Homo sapiens
  misc_feature: GZ8MTXP02HF844.45.79.H02.1.454.CMB.2.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtcgtgggtcctcccgganagtcgatcaccatcctcctgaccactggaaccngcagtgagtggttaggattataccttgtctcgtgtaccanacgcaccaggaccaaccgtacccccaatcatagtatttagtggaggacaggtaacgccgtaccctggtagggtttcctaagttccgtcttccgtcccgtcggtaccctacgtaagtccgtacggaaccaccgtacccgtccctaccgtacgactactcgtacgtcggcctcgagtcgagagacgagtcgtagtattagtctcgcttcnctanatagagtagtagttagttagttcgttggtggtcggacggtacggtacgtagtcgtcgtaccgtacgtacgccgtaaccggcccgtacgtcccgtccccgtacccgtaccgtccgtaccgtcccg

SEQ ID NO: 315532 - DNA, 743 bp, Homo sapiens
  misc_feature: GZ8MTXP02I17BA.45.79.H02.1.454.CMB.2.raw
  modified_base (263)..(264): a, c, t, g, unknown or other
  misc_feature (263)..(264): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggtggattatacttgtctctgtacanncaccagacaacgccccaaatnatntattatggaggcagtaagccggtcctcgtagggtttactacgtcgtcttcctctcggtctaccgtaacgttccgtacggaccgaaccgacccgggtccccttacccccgttagaacctaaacgttcccgttaccgttcggggtcccttacccggacgggtccgttaaggggaacgggtacgttacggggtacggtacgtttaagttaactttttaaacggtttacgttacggttccgtttacggtacccttaaccggttaacttaggttaccgggtacgggtttaaaggggtttaacggtttacgggtttttacgggtttacgggggtttcgggtttaccgggggacgggggtaaacggtaaccgtaaacggtcggtttaccgggtacccgttacggttaacggtaaccgaccggtaccgtacggtcccgtcccggtaccccggttcgttacccg

SEQ ID NO: 315533 - DNA, 638 bp, Homo sapiens
  misc_feature: GZ8MTXP02JWWRJ.45.79.H02.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggattatacttgtctctgtaccangcaccagcaaacgccccaaatcatgtatttangaggcagtaacgcgcctgtagggttctagtcgtcttcctctggtcctacgtaacgtcgtagccaaccgaccgggtccctcccgtagaactaacttccgtcgtcggggtccttaccgacgggtcgtagggaacgggaccggacgggtcgttagttacgtttacgttaccgtgtaccgttcggtctactagttacgttcgacgttaagggttacgttaaggtttcgtttggggttcgggttcgggtacggggacgggaccgtaacgggtcgtaccggtacccgttaccggtacggtcgaaccggaccgacggtcccgtccgtcccccggttacggtcccttacccg

SEQ ID NO: 315534 - DNA, 586 bp, Homo sapiens
  misc_feature: GZ8MTXP02J0RLM.45.79.H02.1.454.CMB.2.raw
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccagcagtgatggttggattataccttgtctctgtaccacngcaccagcaaacgccccaancatnatttngaggcagtagccgcctgagggttctatcgcttcnctgctcaagtctggcaacgacgccctcctagacactctacgtcggcctccgaggcctggacggtacgaggtctaggtaatttacttacgtcgtctcgactcgtagttacgtgacgtaagggttacgtttagttacgttttgggtcgggttacgggacggggtaacggaccgaaggtaccgtacggtaacccgtccgttacggtaccgccggtaacccgaacggtcccgtcccggtccccgttaccgggtaccttcccgg

SEQ ID NO: 315535 - DNA, 691 bp, Homo sapiens
  misc_feature: GZ8MTXP02IXT6P.45.79.H02.1.454.CMB.2.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgattggttgggattataacttgtctctgtacangcaccagacaacgccccaaancatgtatttagtgaggcagtaacgccgcctcgtagggtttctaagtcgtcttcctcgtgtcctactaagtcgtacggccaacgacccggtccctacccgtcgaactaacttcctcgtgggtcccttccgaagggttccgaggaacggacccggagggtaccttaggtaaactttacgtttaacgtcggtaccttggtcccttaactagttaacgtccggtacgttaaagggtttacgttaaggttttaccggtttagggggttcgggtttaccggggacggggtaccggggtaaaccgtaacgggtaccgttcggtaacccgtttaccggttaacgggtaccgaaccgaacccggtaacggggtccctaccccgggtcccccgttcggggtaaccctttaccccgg

SEQ ID NO: 315536 - DNA, 664 bp, Homo sapiens
  misc_feature: GZ8MTXP02GDPYS.45.79.H02.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcatcaccatctcctgcactggaaccngcagtgatggttggattataacttgtctctgtacaacngcaccaggacaaacgccccaaactcatcgatttatgaggcaggtaacgccggccctgtacggggtttactaagtcgtcttcctcgtggctacctaagtccgtggcctaaccgaccggtccctacccgtgacaactcctcgtcgggcctaccgaggctaggacgacgaggtcctagtatttactacgtcgtacgtcgtcctactagttactcgtacgtagggtttagttaacggtttacggttttagggtcgggtttacggggaccggggtaacggggtaacccgtaaacgggtccgttacggtaccccggttaccgttacgggttacccgtaaccggaacccccgtaaacggggtccccgttaccccgggtccccccggtttacgggtacccctttaccccgg

SEQ ID NO: 315537 - DNA, 587 bp, Homo sapiens
  misc_feature: GZ8MTXP02I6FZN.45.79.H02.1.454.CMB.2.raw
  modified_base (227)..(227): a, c, t, g, unknown or other
  misc_feature (227)..(227): n is a, c, g, or t
  modified_base (261)..(262): a, c, t, g, unknown or other
  misc_feature (261)..(262): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (379)..(379): a, c, t, g, unknown or other
  misc_feature (379)..(379): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgatgtgggattatactgtctctgtacacnncaccagacaaagccccaaatcangtatttangaggcaggtacgcgcctgtagggttctaancgtcttcctctgctctagtctggccaacgacggtcctcccgtgaactactcgtcgngggcctacgaggctggacggacgaggtctgtaacttattacgtggtctcgtctactagttatcggtacgtaggtttacgttaacgtttcggtttggggtcggtttacgggacggggtacggaacctaacgggtccgtacggtaccgttacgtaggttccgaacgttacccgaacggtcctacccggtcccccgtaggtacccttcccg

SEQ ID NO: 315538 - DNA, 783 bp, Homo sapiens
  misc_feature: GZ8MTXP02H2X75.45.79.H02.1.454.CMB.2.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagacgcgatcgacacgaccggtgctcgatttagtgtcacacgaagggaaaggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatgtggattatacttgtctctgtaccaanagcacccagacaaacgcccccaaactcatgtactttatggacggggtcaaggtaacggccggtccctacgtacgggggttttacctaaatccggtcctttccgtcctcgggtaccttacccgaaacgttccgtacgggccgtaaaccgtacccgggtccccttacccccgttacgaaacctaaacgttcccgttacccggttcggggacccttcccgaacgggtcccgttaggggaaacgggacccgggaacggtccgttagggtaaactttaatttaaccgtttcggtcctttacggtcttacctaaagttcgtacggtacggtaacgggtttacggttaaagtttacggtttttggggtacgggttttccggggtaccgggggtaaacgggaaacccgtaaaacgggtccgttaaacgggtaccccggttacccggtttaacggaacggttaacccggacccccggtaaaacggttccccgttacccggtccccccccggtttaggggtaccccgttacccg

SEQ ID NO: 315539 - DNA, 862 bp, Homo sapiens
  misc_feature: GZ8MTXP02JCDEJ.45.79.H02.1.454.CMB.2.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcaggtnatggttgggattataacttgtctctggtacaacagccaaccgaggacaaacgacccccaaatcaatgtatttagnggagggctaaggtaacggcccgggtaccccttacggtaacggggtttttacctaaagttccggtactttcccgtcgtcgggtaccttacccgtaaaggttccgttacgggcccgtaaaaccgtaaccccggggtcccccttaccccccgtaaggtaaaccccttaaacgtttccccgttaccgggtccgggggtacccctttacccgggaacggggtacccgttacgggggaacggtaacccggaagggggtccttagggttaaagtttacttttaaacgcgggttaccttacggtcccgttaagtacctttaaacggtttggacccggtttaacggggtttaaaggttttaaaggttttaccgggtttttagggggtacgggtttccgggggtaacccgggggttaaagggaaaccccggtaaacgggtccgttacccgggggtaaccccgtttacccggttacgggttacccgtaaccggtaccccccgtaagggggttcccccttaccgggtccccccccgtttaacggggttaccccctttaccccggg

SEQ ID NO: 315540 - DNA, 672 bp, Homo sapiens
  misc_feature: GZ8MTXP02G8IZC.45.79.H02.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (507)..(507): a, c, t, g, unknown or other
  misc_feature (507)..(507): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngctagtgattggttagggacttataccttgtctcctggtaccangcaccgagacaacgccccaatcatgtatttacgaggacggcagtacggccgtaccgtcggtacgggtttactaacgtccgtacttccctcgtcgtaccgtccgtaaggttccgttacgggacccgtaaaccgtacccgggtacccctaccccgttacggaaacctaacttccgtcgttcggggcccttaccggacggtcgtagggacggacggcgtacgtagtacttacgttacgngtctacgtctatacgtagtcgacgtagggttaagttacggtttccgtttggggttacggttaccggggacgggtaaccggggtaacgcggtaccgttacggacccgtttacggacggtacaaccggtacccggtacgtccgtaccggtcccgttcggacctcccg

SEQ ID NO: 315541 - DNA, 694 bp, Homo sapiens
  misc_feature: GZ8MTXP02GFZE0.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatggttggattataacttgtctctgtacaanagcaccagcaaacgccccaaatcatgatttatgacggcaggtaacgccggcctcgtaggggtttctaagtccgtcgttcctcgtcggactaccaagtcgtcggtaccaaaccgtaccgggtccctaccctacgaacctaaacttccctaccgtcgggtcccttccggacggtaccgttggaaacgggaccgacgggaccgtaggtaactttacgttaactcggtcttcggtacttacgtacgttaagtcgtaacgtagggtttaaacggtttcgttaaggttttcggggttcggttaccggggtacggggtaaaccggggtaaaccgtacggtaccgtaccgggtaacccgtaccggttaacggttccggaaccggttacccggaaacggtccccgttaaccggcccccggttcggtaccccgtttaacccg

SEQ ID NO: 315542 - DNA, 561 bp, Homo sapiens
  misc_feature: GZ8MTXP02JKM68.45.79.H02.1.454.CMB.2.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggattataaccttgtctctgtaccaacngcaccagcaaacgccccaaacncangatttangaggcagtaacgcgcctgtagggttctatcgtcttcctcgtgcctcaagtctgcaacacggccctccctagactactcctcgtcggacctccgaggcgtaggacggacgaggccgttagatttaacttacgtcgtctcgcttacacgttatgacgaggttagtacgttacgtttggtgtcgggtacggtacgggacctaacgtcgtcggaccgtccgttaggtccgaacgtacccacggcctccgcccccgtggtacctccg

SEQ ID NO: 315543 - DNA, 617 bp, Homo sapiens
  misc_feature: GZ8MTXP02H6G3O.45.79.H02.1.454.CMB.2.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccntctctgcactggaaccngcagtgattggttaggattactacttgtcctcgtgtaccaacacgaccaccgagacaaaccgccccaaactcatacgtatttagagaggctaaggtaacggccgtacccgtagtacggggttactaacgtcgtacttcctcgtcgtcctacctaagttcgtcgggaccaaaccgaccgtcccgtaccctagaacctacttccgtacgtcgggactcccgaggtcgacggaaggaccggagtacgtagtacttaagtctggactgtactcagtagtcgagttaaggtagtttaagttcgtttgggtggttaccggagggtacggactacgtcgtacgtaccgtacgtaacgtcgaaccggacgacgtccctacggtcccctacggtctacccg

SEQ ID NO: 315544 - DNA, 628 bp, Homo sapiens
  misc_feature: GZ8MTXP02JOE71.45.79.H02.1.454.CMB.2.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttagggattataccttgtctcctgtaccacagcacccaggaccaaacgccccaaancatgatttanagaggacaggtaacgccggacctgtagggtttacaacgtcgtcttccgtcgtcggtctaccgtagtcgtcggacctaacgaccggtccctcccctagaacctaactcgttcgtcggcctacccgaggtcgtaggaggaccggaggtactggtaattacgttacgttcggattaccgtcgtacgtagttagtcgtacggtaaggtttacgttacggtttacggtttaggggtcgtacggggtacgggtaacggaccgtaacggtccgtacggtaccgtacgtacgacgaaccgtaccggacgtccgtccgtcccgtacggtactccg

SEQ ID NO: 315545 - DNA, 499 bp, Homo sapiens
  misc_feature: GZ8MTXP02H9BE8.45.79.H02.1.454.CMB.2.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagacgcgatcgacacgaccggtgctcgatttagtgtcacacgaagggaaagggggtcacaagaggcagcgctctcgggacgtctcaccatggcctgggctctgctgctcctcactctcctcactcaggacacagggtcctgggcccagtctgccctgactcagcctgcctccgtgtctgggtctcctggacagtcgatcaccatctctgcatggaaccngcagtgatgtggattatactgctctgtacangcaccagcaaagccccaaatcatgatttangaggcagtaagcggccctgagggttactaatcgtcttccnctggctccaagtctggcaacgtacgcctcctgacaatcnctggctcagcngagcgagctgnttagtctgctgtntcanatgngagtagtagttagttgtgtcggtcggacggacgaacgacgtcgacgtcgtacgtacgaacgaccgaacgacgtcgcccgtaccggttaccgtacg

SEQ ID NO: 315546 - DNA, 777 bp, Homo sapiens
  misc_feature: GZ8MTXP02IPOGQ.45.79.H02.1.454.CMB.2.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtcctcctggacagtcgatcacatctcctgcactggaaccagcagtgatggttagggattactaacttgtctctggtaccaanagcacccaggacaaacgcccccaaactcactgtaatttanggaaggcaggtaaacgccggccctacgtaggggtttctaagtcgtcttccctctggtctacctaagtcctggaccgaaaccacggtccctcccctaggggaactaaagttcctcgttgggcccttacccgaggtaccgttagacgggacccggtaaaggtcccgtttaagggtactttaaacgtttaacgttcgggtacctttacggtaccttccgttaacttaaagttccggtacgttaaacggggtttaggtttaacccggtttaaacggtttttgggggttaacgggttttccgggggtaacggggtaaccgggggaaaccccgtaaggggttaaaccgttccgggtaacccggtttaaaccggttccggggtttaaaccgtaaacccgggacccccggttaaaacgggggtcccccttaacccgggtacccccccggttttccggggtaaacccctttacccccgg

SEQ ID NO: 315547 - DNA, 715 bp, Homo sapiens
  misc_feature: GZ8MTXP02JL7ZH.45.79.H02.1.454.CMB.2.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (342)..(342): a, c, t, g, unknown or other
  misc_feature (342)..(342): n is a, c, g, or t
tcagacgcgatcgacacgaccggtgctcgatttagtgtcacacgaaggggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacngtcgatcaccntctcctgctacgtggaaccngcagtgtagttggttagggtattactaccgttgtcctccgtaggtaccaacgacgaccaacccgacggaaccaaacccgtacccccaaacgttcagttagttaatttacggnggaacgggactaaggtaccggcccggtcccgttacggttacgggtttactaacgtcgtaccttccgtcgtcggtactaccgtagtcgacgcctaaccgtaccggtcccgttaccacgaactacctccgtacgtcggtaccctacgacggtcctaggggaacgtacgggagttaccgtagttaacgtttacgttaccgtcgttacgtcgtaccttacgtagtacgtacggacggttaggttaaacgtttcggtttaaggttggggttaacggtcgggaaacgggtacgggtactaacggtccgtaacggttcccgtacggttacgaccgtaacggacccgtacggtacccgtccgtcccgtacgtcttaacccg

SEQ ID NO: 315548 - DNA, 605 bp, Homo sapiens
  misc_feature: GZ8MTXP02I50JT.45.79.H02.1.454.CMB.2.raw
  modified_base (227)..(227): a, c, t, g, unknown or other
  misc_feature (227)..(227): n is a, c, g, or t
  modified_base (264)..(265): a, c, t, g, unknown or other
  misc_feature (264)..(265): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcatcaccatctcctgcactggaaccngcagtgattggttggattactaacttgtctctgacanncaccagacaaacgccccaaatcatntaggtttanggaggacaagtaacggccggtccgtagtacggggttttaccaagtccgtctaccgtcgtgtcctacgagttccngccaacgccgtcctccngacactctcgngtcctacgnggctagaggaccgagtctagacttactacgtncgttcnctactagttagacgtagtaaggtttacgtttacggttgtttagggtcggttacgggacggggtaacgacgtacggtaccgtaccggtaccgtaccgtacggtacgaaccggtaccggtaccggtcccgttacccggtaccccgttcgtaccttcccg

SEQ ID NO: 315549 - DNA, 665 bp, Homo sapiens
  misc_feature: GZ8MTXP02GR89V.45.79.H02.1.454.CMB.2.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (467)..(467): a, c, t, g, unknown or other
  misc_feature (467)..(467): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcaccatctcctgcactggaaccngcagtgatggttgggattatacttgtctctgtaccacngcaccagacaacgaccccaancatnattangaggcagaagccgcctagtagggtttcaagtctcttacctcgtcgactaccaagttccgtaggcctaacgccggtccctcccctagactactcctcgtacggcctaccgagtcgtaggacgaccggtaggtctacggttaatttagttacgtcggtacgttacggtccttanagttacgtcgtaacgttaagggtttaccggtttaaggtttaccggtttggggtttcggggttacccgggaagggggttaaccggaaaccgtaacggtcccggttaacggtacccccgttacggttacgggacccaacgggtaccccgaacgggttcccgtccccggtacccccgttccgggttacccttaacccccgg

SEQ ID NO: 315550 - DNA, 653 bp, Homo sapiens
  misc_feature: GZ8MTXP02I4IW4.45.79.H02.1.454.CMB.2.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (518)..(518): a, c, t, g, unknown or other
  misc_feature (518)..(518): n is a, c, g, or t
tcagacgcgatcgacacgaccggtgctcgatttagtgtcacacgaagggaaagggggggtcacagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactggaaccngcagtgatggttgggattataacttgtctctgtaccaacagccacccnggaccaaacgcccccaaactcatagtactttagtgaggtcaaggtaacgtccggacccgttcgtacggggtttactaactcgtcttcctcgtcggtctacccgaagtcctcggccaaccgtaccggccctacccgtagtaacctaactccgtccgtcgggtccctaccgacgggtaccggttacgggacgggaccggtaacgggtccgttagtacgtttaacgttacgtcgtacgtcgttacaccntttaagtgacctagggttacgtaggttaccgtttggggtcgttacgggcggttacggggacctaaaggccgtaggacccgtcgtaacggtcaacggaccccaacggtcctacggccccccgtggtaccctacccg

SEQ ID NO: 315551 - DNA, 656 bp, Homo sapiens
  misc_feature: GZ8MTXP02HJUW8.45.79.H02.1.454.CMB.2.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcngcactggaaccngcagtgatggttagggattatacttgtctctgtacaacngcacagacaacgccccaaancatgtattatggaggcagtacgcgcctgtagggttctaagtcgtacttcctcgtccggtacctacgttactcgcgtaccgacccgaccgtccctaccgtacgtactactcgtcggtacgtacccgtacgtacggtacggagggaaccggacgggtacgttccggttaacgtttagtttaccgtaggtccggttctaccggtaaccgttacttaggtaccggttacgtaaccgggtttaaggttaaccgttttaacgggtttagggtttcggggtacggggttaccgggtacgggacggaaaccgtggtaccggtaccgtacgtacggtccacgtaaccggacgcgtccggtacccgtccggtcttacgtcccg

SEQ ID NO: 315552 - DNA, 597 bp, Homo sapiens
  misc_feature: GZ8MTXP02IYFBG.45.79.H02.1.454.CMB.2.raw
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatgttgggattatacttgtctctgtacanagcaccaggacaaacgccccaaatcatgtatttanggaggcagtaacgcggtcctcgtagggtttctaactcgtcttctcgtggcctccgaagttcgtcgctaaccgacggtccctcccgtagacaactctcgtgggcctccgaggctaggaggacgaggctagacttatactgtctgtctcgattacgtgacgtaggtacgtaagtttaccggtttgggtggtttaccgggacgggacgggtaaaccgacggtaccgttacgtaccccgttacgtacggttaccgaacgtaccccgaacgggtccctaccggtacccccgtacggtccttaacccg

SEQ ID NO: 315553 - DNA, 602 bp, Homo sapiens
  misc_feature: GZ8MTXP02HOMU6.45.79.H02.1.454.CMB.2.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctcctgcactggaaaccngcagtgagttggttgggattaactaaccttgtcctcctaggtaacccaanacgacccaaccgacggaccaaaaccgaccccctaaaactctattagtaactttagnggaaggcaagttaacggccgtccgtagtacgggtttctaatcgtcttcncgtgtctacagtcctgcaacgcgcctccanacactctcgtcgctccgngcgtggacgacgaggtctagtattaacgttacgcgtctgtactatagtagtagacgttaggtacgttaggttacggtttcgggttagggtcgggtacggtacggacgaacgtcgtacgaaccgtcgtacggactaaccgcgtaacgcccgttccgcccggtactacgtcc

SEQ ID NO: 315554 - DNA, 534 bp, Homo sapiens
  misc_feature: GZ8MTXP02IN025.45.79.H02.1.454.CMB.2.raw
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (359)..(360): a, c, t, g, unknown or other
  misc_feature (359)..(360): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattataactgtctctgtaccaacagcaccagacaaacgccccaaatcatgattangaggnagtagcgcctgtaggttcatcgtcttcctctgctcagtctgcacacgcctccngacatcnngctcagctgagacgagctagtattagttactgtntcgtctactattancgagtaggttaagtagttacgtttggtcgtcggggtacggagggaccgtaacgcgtaccggtaccgtccgttaacggacgaacgaccccggaaagtcccgtccgtcccccgtccggtacctacccg

SEQ ID NO: 315555 - DNA, 649 bp, Homo sapiens
  misc_feature: GZ8MTXP02G2WPH.45.79.H02.1.454.CMB.2.raw
  modified_base (208)..(208): a, c, t, g, unknown or other
  misc_feature (208)..(208): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccagcagtgatggttagggattactacttgtctcctgtaccaangccaccaggacaaacgccccaaatcatgatttagnggacggnagtacgcgtcctagtagggtttactaatcgtctttcccgtcgtcgtacctacgtaagttccgtaggccgtaaaccgtacccggtccccttaccctaggaaacctaacttcccgtccgtcggggtccctaccgacgggtccgtagggacgggaccggtacgggacttaaggtactttaacgttacgttcggtctcgttactactagtagtcgtagttaaggttaggttacgtttacgtttgggtacggttacggggacggtacgggtaacacggtacgtacggtaccgtacgtacgtacgaaccgtccgaacggtccgccgtccccgtcggtacctcccgg

SEQ ID NO: 315556 - DNA, 827 bp, Homo sapiens
  misc_feature: GZ8MTXP02JDMDW.45.79.H02.1.454.CMB.2.raw
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgaatcagcctgcctccgtgtcgtggtctccgtggacagtcgatcacctatcctcctgcctacgtacggaaccagcaggtgtagttggttagggtaatttactaaccgttgtccttccgtacggtaaccaacgacgacccaaacccgaaacggaaaaccccgacccccctaaaactcctaaagttacgtaaagttttaacggtagggaacggggtaaccgtaacgggtaaccggtccccggttacccccggtttacggggtttaaccggggtttttaaccctaaacggttcccgttcccgttttaccgtcccgtttacccgggtacccttaacccggtaaccggtttccggtaaccgggaacccctaaccgggtccccggtcccccttacccgtacgtaaccctaacgttcccgttccgggttccgggtacccttacggacggtacggttacgggaacggggtaacccggtaggtacgtttaggttaactttacgttcgtacggtcttaccgtacttagtacgttagttacggtacgttaagggttagtttacgtttacgggttggttacgggtcgggaacgggtacgtacgtacggtcgtacggttaccgtcgaacgtccgaccgccggtacgtcccgtcccgtacccgtcgtacttccgttcccg

SEQ ID NO: 315557 - DNA, 661 bp, Homo sapiens
  misc_feature: GZ8MTXP02GXGEH.45.79.H02.1.454.CMB.2.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccngcagtgagtggttgggattactacttgtctcgtcgtaccaacacgcaccagacaaaccgaccccaaactcatgtatttagnggaggnaagtacgccgcctagtacgggttactagtcgtcttcctcgtcgtctaccgagtcgtacgcctaaccgaccgtccctccgtacgaactacttccgtacgtcggcctaccgacgtcgtacggacggacggaggtcgtagttacttacgttacgtcgtacgttcgtactactaacgttactacggtacgtaagggttaagtttacggtttacggttttggggtacggttaccgggggacgggtaacgggtaccgtaacggtccgttaccggtaccgttaccgtaaggttacccgaacggaccccgtaacggtccccgtacccggtacccccgttcggtaccgttaccccg

SEQ ID NO: 315558 - DNA, 734 bp, Homo sapiens
  misc_feature: GZ8MTXP02I4GXQ.45.79.H02.1.454.CMB.2.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccngcagtgatggttgggattatactgtctctgtaccanagcaccagacaaacgccccaaatcatagtatttanaggtaggacaaggtaacgccggtaccctcgtacggggtttactaacgtccgtacctttcctccgttcgggaccttaccgtaacgttccgttacgggacccgtaaaccgtaccccgggtcccttacccccgtagtaaccgtaaacttcccgtaccgtacgggggtcccttacccggaggtacccgttagggaaacgggaccggtacggaccgttaggtaaactttacgttaacgtacgtcgttcggtacttacgtacgtaaccgtgtaccggttaagttagggtttaacggtttaacgggtttacggtttcggggtacgggttaccggggagggtaaccgtacggtacgttacggtcccggtaaccgttacggtaccgaacccggtaccgtaaacggtcccgttacccggcccccgtttaacggcccgtttaacccgg

SEQ ID NO: 315559 - DNA, 688 bp, Homo sapiens
  misc_feature: GZ8MTXP02JH11Z.45.79.H02.1.454.CMB.2.raw
  modified_base (235)..(235): a, c, t, g, unknown or other
  misc_feature (235)..(235): n is a, c, g, or t
  modified_base (285)..(285): a, c, t, g, unknown or other
  misc_feature (285)..(285): n is a, c, g, or t
  modified_base (328)..(328): a, c, t, g, unknown or other
  misc_feature (328)..(328): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgtggacaggtcatccacctatctcctgctacgtacggaaccngcgagtgtagttgggttaggggtattactacgttgtctcctaggaccaancgacacccgagaccaaaccgccccaaatctatagttaattagnggaacgacgaagtacggcccggtaccgttggttagggtttacctaagtccgttacttcccgtccgtacggtacccttacggtacgttccggacgtacccgaaaccgtcccggttaccccttacccgtacgtaactacgttccgttacgggtccgaacgttccggacggtgaacggggtaacgacggacgtactaggttacttacgttacnggttctacgtntacgtagtacgaggttagtaggttatttcggttacgttgggtcgtaccgggaggtacggacgtacggacgttccggtaccgttacgacgccgtaacgaccgacggttccgtccccgtacccgttccggtactttcccgg

SEQ ID NO: 315560 - DNA, 657 bp, Homo sapiens
  misc_feature: GZ8MTXP02I7ER3.45.79.H02.1.454.CMB.2.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (514)..(514): a, c, t, g, unknown or other
  misc_feature (514)..(514): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacgagggtcctgggcccagtctgccctgactcagcctgcctcgtgtctggtctcctggacngtcgatcaccntcctctgcacgtggaaccngcagtgattggtgggatttactaacttgtctacctggtaccaacgagccacccgaggacaaccgacccccaaactccaatcgtatttacaggacggacaaggtaacggcccggtacccgtcgttaggggtttactaacgtccgtcctttccgtcgtaccggtctacccgtaagtccgtcggcctaacgaacccggcccgttaccccgtctaaacgtacttccgtccgttcggtcccttacccggaggccttagggaacggacccggagggtctaggtacttattacgngtcttcgtctactgtacgtgacgtaggtttagtacgttacggtttgggtgtaacggggcggtacggaccgtacggtcgtacgtaaccggtccgtaggttaccaacggacccgtacgcctcccggcccgttacggcttaccccg

SEQ ID NO: 315561 - DNA, 526 bp, Homo sapiens
  misc_feature: GZ8MTXP02FKQ5Z.45.79.H02.1.454.CMB.2.raw
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataccttgtctctgtaccaangcacccaggcaaacgccccaaatcatnatttangaggcagtaagcgcctgagggtttcatcgcttctctgctcagtctggcaacncggcctcctgacatctctgggctccgaggctgaggacgagctgtattattactgctgctcatatgacgaggttagttagttacgtttgggtgttcgggacgggtacgggacctaaggctacggaccgtcgtacgggtcaacgtcccaacggtcctaccgcccccgtcggtcctaccg

SEQ ID NO: 315562 - DNA, 599 bp, Homo sapiens
  misc_feature: GZ8MTXP02GXFW4.45.79.H02.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctccgtggacagtcatcaccatctctgcactggaaccngcagtgagtggttagggattactacttgtctctgtaccaanancaccagacaaacgaccccaaatcatcgtaatttanaggacggacaaggtaacggccggtcctacggtaggggtttacaagtcgtcttaccgtctacggcctacgacgtcgtcgccaaacgaccggtccctaccgtagaactaacttccgtacgtcggtcctacgaggccgtggaggtccgaggcgtagtaattagttacgcgtacncgtactactagtancgtagtaggttacgttgtacgtttggtacgtcgggaggtacggacgaagtcgtacgtaccgtacgtacggtacaacgcgaacggtccgaccgtcccgtacggactttccccg

SEQ ID NO: 315563 - DNA, 621 bp, Homo sapiens
  misc_feature: GZ8MTXP02FIIL0.45.79.H02.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (467)..(467): a, c, t, g, unknown or other
  misc_feature (467)..(467): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatggttggattatacttgtctctgtacaacngcaccgagacaaacgccccaaatcatgatttagngaggcagtaacgccgcctcgtaggtttcaatcgtcttcctcgtcgactacgagtccgtggaccaaaccgccggtacctcccgtagaactactcttacgtcgggtcctacgaggtacctaggacggacggaacgtctaggtaactttagttactgtctcgcttactaagttntcgtacgtagggtttacgttacggttacggtttcggggttacggtaccggggtacggggtaacggtaaccaaggtaccgtacggtaccccgttacggcgttaaccgaaccgacccgtaacggccgttccgggtaccccctcggtacccttaccg

SEQ ID NO: 315564 - DNA, 621 bp, Homo sapiens
  misc_feature: GZ8MTXP02IJBA9.45.79.H02.1.454.CMB.2.raw
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctctgcactgaacngcagtgatgtggattatactgtctctgtacanancaccagcaacgaccccaancatntattangaggacaggtaacgccggtacctagtacgggtttactaacgtcgtctttcctcgtcgctacctaagttccgtcggccaacgacgtccctccctagactaatctacgtggcctcgaggtctaggagacggagactagtacttactactacgtctcgtagtctatacgtgaacgtaggttagttacggtttacgtttggggttacggttacgggacgggtaaacgggaaccgtaacggtaccggtaccggttaaccggttaccggttaacgaccggaacccgtaacccgggtaacgtcccggtacccggtacccccgttaccggttaccttaccccgg

SEQ ID NO: 315565 - DNA, 539 bp, Homo sapiens
  misc_feature: GZ8MTXP02GNIGD.45.79.H02.1.454.CMB.2.raw
  modified_base (226)..(226): a, c, t, g, unknown or other
  misc_feature (226)..(226): n is a, c, g, or t
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (440)..(440): a, c, t, g, unknown or other
  misc_feature (440)..(440): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatggttggggattataaccttgtctcctggtaccaacngccacccaggacaaacgaccccaaatcatgatttangaggcagtaagccggcctgtaggggtttcaatcgtcttcctctcggctccaagtctggcaaacgacggcctaccctgaacaatctctgggctacccgaggctgagacgaggctgattattactgctgctcatangcgtaggtagtagttacgttggtgtcggcggacggactaagcgtacgtaccgtacgtagtcgaacgtcccgaacggtctccggccccgtcggtctaccg

SEQ ID NO: 315566 - DNA, 591 bp, Homo sapiens
  misc_feature: GZ8MTXP02GQONP.45.79.H02.1.454.CMB.2.raw
  modified_base (228)..(228): a, c, t, g, unknown or other
  misc_feature (228)..(228): n is a, c, g, or t
  modified_base (461)..(461): a, c, t, g, unknown or other
  misc_feature (461)..(461): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactggaaccngcagtgattggttagggattactaacttgtctcctggtatcagcaacaccagacaaacgcccccaaatcaatctatttatgatgtacaataactccggcctacgtagggtttctctactcgtactttctacgtcgccttactacgtctacggactaactaccggtccctccgtacgacctatcctcgtcggctccgagtctaggaacgtacggagactaggtattattacgtnactagacaactataattattagttcgttaccgtacgttcggttacgtcggggacggtacgggtaacctaggttccgaaccgtcgttacggaacgtacgaccgtaagccgtaccgccccgttacggtaccc

SEQ ID NO: 315567 - DNA, 662 bp, Homo sapiens
  misc_feature: GZ8MTXP02F25UT.45.79.H02.1.454.CMB.2.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactggaaccngcagtgatggttggattatactgtctctgtacaanagcaccaggaccaaaccgaccccaatcatgtaatttangaggacagtaacgccgtcctagtacggttctagtcgtacttccgtcgtcgctaccgtagtcgtcgaccaaccgtcgggtccctaccctagtaactacgtcctaccgtacgggtccctcggtaagggccttacggggaacggtaccgggtaggtacgttagtaaacctttaagttaccgtccggtcgttcggtactacgttaagtcgtagtaaccgttaggttaagtttaacggttcggtttaggttcgggttacgggacgggtacggaaaccgtaacggttccggtacgtacccggtttacgacgggttaccaaccggtaccgaaccggtccgtcccgtaccccggttcgacgtttaccccg

SEQ ID NO: 315568 - DNA, 709 bp, Homo sapiens
  misc_feature: GZ8MTXP02INZDQ.45.79.H02.1.454.CMB.2.raw
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatctcctgccactaggaaccagcagtgagttggttgggtattactacttgtctcctggtaccaacacgccaccacggaccaaaccgaccccaaactcatagtatttagaggaggacaaggtacgcccggtaccgtacgtacgggtttactacgtcgtcttcctcgtcgtcctacgtacgtcgtacggcctaaccgtacccggtccctacccgtacgaacgtaccttccgtacggtcggccttaccggacggtcgtagggaacgggacgagggtctaagttatttacgtacgtgtacgtgtacctactagttacgtcgtacggttaaggttacgtttacggtttaccggtttagggtcggggttaaccggggtaacggggtaccgggtaaaccggaccggttaccggtacccgggttaccgttccggttaacggtaccgaacccggtaacccggtacggtccccgtaacccggtcccccgttcggttaccttaaccccg

SEQ ID NO: 315569 - DNA, 619 bp, Homo sapiens
  misc_feature: GZ8MTXP02FX8DA.45.79.H02.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (543)..(543): a, c, t, g, unknown or other
  misc_feature (543)..(543): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactcctcctcactcaggacacagggtcctgggcccagtctgccctgactcagcctgcctccgtgtctggtctcctggacagtcgatcaccatctcctgcactggaaccngcagtgatggtggtattatacttgtctctgtacanagcaccgagacaaacgacccctaaacncactgtatttanacggaggacaaggtaacgccggtccctcggtagggtttctaacgtcgtcttcctcgtggctaccgtaagtccttacggaccaaccgaccggcccttacccgtagaactaactccgttcgtccgggtcctacgacgtcgtaggacggcgtaagcgttgtaattctttagcgcttcgcttagattagcgtagtaacggttagttacgtttagtttgggttacggtacgggacggtacggtaaacncggtacgtaccgtaccgtaccgtacgtacgaaccgacccgtacggtccgtacccggtacccgtaccgtaccgtccg

SEQ ID NO: 315570 - DNA, 518 bp, Homo sapiens
  misc_feature: GZ8MTXP02FFS1T.45.79.H02.1.454.CMB.2.raw
  modified_base (212)..(212): a, c, t, g, unknown or other
  misc_feature (212)..(212): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacatctccngcactggaaccagcagtgatggttgggattataacttgtctctggtacaacagcaccaggacaaacgccccaaaatcatgactttatgaggacagtaacgcggcctcgtagggtttcatcgcttctctgctcagtcngcacncgctccngcatcntggctcgagctagagacgagctgattatctgntgctcattancgacgaggttagtntacgttgggtacgtcggacggagggacctaaagccgttcgaccgttacgacggcaaccgcccgtaacggcctccgtaccccgtcggtctaacccg

SEQ ID NO: 315571 - DNA, 585 bp, Homo sapiens
  misc_feature: GZ8MTXP02JA1D1.45.79.H02.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctggtctcctggacngtcatcaccatctcctgcacgtggaaccngcagtgatggtggattatacttgtctctgtaccangcaccagacaaacgccccaatcatgatttatgaggcagtaacgccggcctgtagggtttactaagtccgtcttcctctcggctacgaacgtctcggacaaccgtaccggcctcccgtacgaactaactccgttcgtcgggccctccgaggtcctagggacgacggaagggtcttcgtaatttattacgtgtcgttactctactattactggtacgtaaggttagttagttacgtttgggtcgttacgggacggaggtaccgaagtcgtacgtaccgtcgtacggtcaaccgtaccgacggtcgtaccgtccccgtcgtcttacccg

SEQ ID NO: 315572 - DNA, 533 bp, Homo sapiens
  misc_feature: GZ8MTXP02FHKLN.45.79.H02.1.454.CMB.2.raw
  modified_base (268)..(268): a, c, t, g, unknown or other
  misc_feature (268)..(268): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacngcacccaggcaaagcccccaaatcatgatttatgaggcagtaagcggccctcgagggtttcaatcgtcttcctctgctcaagtctggcacacgctccngacatcnctggctcgagcngagacgaggctgattatactgctgctcatatgacaggttagttagtacgtttgggttgttcggcgggacgggacaaaggtcgtacggtacccgttacgtaggtaccaacggtacccgaacggctaccggcccccgtcggtcctaaccg

SEQ ID NO: 315573 - DNA, 693 bp, Homo sapiens
  misc_feature: GZ8MTXP02I9P68.45.79.H02.1.454.CMB.2.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacngtcgatcaccatctcctgcacgtggaaccngacaggtgattgggttgggtaatttataaccttgtctccgtgtatcacgacaacacccaggaccaaaacgacccccaaactctatactaatttacagtatgtacaaataacgtccgaccctcgtagggtttctacgtactccgtcttcctcgtcggtccttaccgacgttcctagggtaccttaaacgtaccccgggtcccttacccccgtacgaccctaagttccctacggtccggtcctacccgtggtccgtaacggaacgaccggaggtactaggtactttaacgtactcggtaacacgtactaactattaacttacgtttacgttaccggtttacaccggtttaccgggttacggtttaccggggaacgggtaaccgggtaacgttaacggttcggtaaaacccgtcgttacgggtaaccgtacgacccgttaggcccgtacccggtccccgtcgtaccc

SEQ ID NO: 315574 - DNA, 829 bp, Homo sapiens
  misc_feature: GZ8MTXP02JZ664.45.79.H02.1.454.CMB.2.raw
  modified_base (305)..(305): a, c, t, g, unknown or other
  misc_feature (305)..(305): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctcctgcactggaaccagcagtgatggttagggtattatacttgtctctgtaccacagcaccgacggacaaacgaccccaatcatagtatttanggaggacaggtacgccggtcctcggtacggggtttactaacgtccgtacttcccgtcgttcggtaccttaccgtaacggttaccgttacgggtacccgaaaccggtaaacccccggggtcccctttacccccgtaacggtaaaacccttaaaccgttaccccgtttacccggttcgggggtacccccgttacccggtacgggggttacccggttacgggggaaaccgggggacccgggttacgggggtacctttaaggttaaacgttttaagtttaccggttacgtcgttaaccggctttacccgtaagtttaaaccggtcggttacccggttaaaagggggtttaaccggtttaaggttttaaccgggttttcggggttacgggggtttaccggggaacgggggtacgggtaaacccgtaacgggtcccgtttaacgaccccgggttaccgtaacgggttacccgaaccggtacccggtaacggtcccggttacccggcccccgttaacggtccctaccccgg

SEQ ID NO: 315575 - DNA, 663 bp, Homo sapiens
  misc_feature: GZ8MTXP02GJP9C.45.79.H02.1.454.CMB.2.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
  modified_base (504)..(504): a, c, t, g, unknown or other
  misc_feature (504)..(504): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactggaaccngcagtnatggtggattatacttgtctctcgtacaacgnaccaccaggaccaaacgaccccctaaancactgtaatttagtcggaggacaaggtacgccggcctggtacggggtttnaacgtcgtcttcctccgtggtctacgtagtctcgacgaaccgacggtcctacccgtanaacgtaactcgtccgtacgggtacccttaccggaacgtcgaggaacggaccggtaggtaccgttagttaaacgtttacttacgtcgtcgtcgtacctataacgtntacggtcgttaaaggttcgttaaagtttacggtttggtcgggttaccgggcggttaaaccggggaccctaagggtacctaccggttccgttaacccgttacggacccaaccggacccggttaacgcccgttacccgcccggtttaccgtcgtttacccc

SEQ ID NO: 315576 - DNA, 614 bp, Homo sapiens
  misc_feature: GZ8MTXP02H36CJ.45.79.H02.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (227)..(228): a, c, t, g, unknown or other
  misc_feature (227)..(228): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggccagtctgccctgactcagcctgcctccgtgtcgtggtctccgtggacagtcgatcactntctccngcatgaacngnngtgatggtggattactacttgtctctcgtacacngcaccagacaaacgccccaatnatgtatttanggaggnaagtacgcgtcctgtaggtttacagtcgtcttcctcgtcgtacctacgtagtttccgacgggccaaacgtcccggtccctaccctagtaaaccgtatcccgtacgtcggacctcgaacggtcgcgggaaacggccggtaaggcttaggtaactttgttaccgtggtcttcgtctacggtatacgtacggaagttggttacgttacgtttggttggtacgggtacgggtacggacggtacgacgtcgttacggaccgtacgttacgaccgaacgtaacccgtacggtccctccggtccccgttcggtacctcccg

SEQ ID NO: 315577 - DNA, 669 bp, Homo sapiens
  misc_feature: GZ8MTXP02IKBKC.45.79.H02.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (221)..(222): a, c, t, g, unknown or other
  misc_feature (221)..(222): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcacntctctgcactgaacnncagtgatggtggtattatacttnctcgngtacanagcacgagacaacgccccaatnatntatttagngaggctaaggtacgcccgtccttacggtacgggtttacaatcgtcttccgtcgtgtacctacgtaagtcgttacggacctaaccgacccggtaccccttcccgtacggtaactaacgttcccgtcgttcggggacccttccgaaggtcgtacggaggaccgtacggtataggtactttaacgtcttcggtatcggtactacttattaaccgggtagtaacggttaggttacgtttacggtttacgggtttacgggtacgggttaccgggaacggggtaaacggtaccgtacggttaccggtacccggttaaccggtacgttaccggtaccgaacccggtaccgaccgttcccgacccggttcccgttacgtaccttaccg

SEQ ID NO: 315578 - DNA, 654 bp, Homo sapiens
  misc_feature: GZ8MTXP02GYDAZ.45.79.H02.1.454.CMB.2.raw
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
tcagacgcgatcgacacgaccggtgctcgatttagtgtcacacgaaggggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcacatctcctgcactggaaccngctagtgagttggtagggtattactacttgtcctccgtagtaccaacncgccaaccgaggaccaaaccgccccaaatcatcgtatttgngaggnagtacgccgtcctagtacggggttactacgtcgtcttccgtcgtcggtcctaccgtaagtccgtcgaccgaccgtaccggtccccttccagtaactacgttccgtacgtcggtaccgtcgacggtccgtaggacgggtacgtacggtcgttagttacgtttaacgttacgtacgtcgtcgtctacgttagttaagttacggttaaggttacgttacggtttacggtttggttacggttacgggacgggtaacgggaccgtaggtaccgtaccgtaccggtacgtacgtacgtaacgccgtaacgcccgttaccgcccgtcgtcctacgttccccg

SEQ ID NO: 315579 - DNA, 919 bp, Homo sapiens
  misc_feature: GZ8MTXP02JY8I3.45.79.H02.1.454.CMB.2.raw
  modified_base (228)..(228): a, c, t, g, unknown or other
  misc_feature (228)..(228): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtgaaaccangtgatggttggtattttagttgtctcctaggtaccaacaaccgaccccggacgaaccgacccccaaaactaatactaactttaagtaacgggaactaaaccgtaacggtcccgggtaccccggtttacggggggttttacaaacggttccggtacctttccgtccgttacgggtccttaccccgtaaacggttccgtacggggtaaccctaaacgtaccccgggtaccccttacccccgtacgtaaccccttagttcccgttaaccggttcgggggtcccttacccgggaacggggtacccttaaggggaaaacgggaccgggtaaacgggtccgttaagggttaaacttttaaacgttacgttacggaaccgtaaccggtaactaacccgttaaatttaaaccgtttaagtttttaaacggttacggttttacccgttaacgggtttaccgggggtttaacgttccgggggtaaccggggtaccgggggtaaacccgttaaagggtttaccggtaacccgggtttaccggtaaacgggtttcccgaaaaccggccccggttaaaacgggtccccgttaccccgggtaccccccgttccggggttacccctaacccggtttaacccgttcccccggtttacccccgggtcccccttcccgttaccccggtcccggttaacgttcccccggg

SEQ ID NO: 315580 - DNA, 635 bp, Homo sapiens
  misc_feature: GZ8MTXP02GQM7P.45.79.H02.1.454.CMB.2.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctgacagtcgatcaccatctcctgcactggaaccngcagtgattggttacgggtattactaaccttgtacctcgtggtaccaacagccaccgagaccaaacgaccccctaaancaatgtatttagngaggctaagacgcgcctgtacggttnagtcgtcttctcgtgtctctagtctaggcaacgcgcctccagactatcctagtcggcctacgaggctagacggaccgaggtcttagactttacgttagtcgtactcgttctacgtaatacgtacggtacgtaaagggtttacttaaacggtttacggttcgggttcgggttaaccgggggtacggaaacggtacccgaaaggtcccgttaccggtaacccgtaccgtacggtaccggaaccgtaccccggtaacgtcccgtcccggtacccccgtttcggtacctttaccccgg

SEQ ID NO: 315581 - DNA, 657 bp, Homo sapiens
  misc_feature: GZ8MTXP02IZMYH.45.79.H02.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacngtcgatcaccatctcctgcactggaaccngcagtgattggttgggattactaaccttgtcttctggtaccaacngcacccaggcaaacgcccccaaatcgatacgtatttagtgacggnaagtagccggtcctagtagggttctaactcgacttccncgtcgctacgacgtctacggcacacggtcctccgtgacacttcgcgtcggcttccgacgggctaggacggtaccgaggtccgtaggtaaacttcttaacgtgtacctggtacttaccgattaacgtcgtaacgttagggtaaacgttagtttaaccggtttaggtttcgggggtttacccgtagggggaaaccgggttaacccgtaaacggccgttacggacccggtttaccgtaacggttacgaaccggtaccccggtaaacgggtaccttaccccgggtccccgtacgttaacccgtacccg

SEQ ID NO: 315582 - DNA, 564 bp, Homo sapiens
  misc_feature: GZ8MTXP02FRYQ1.45.79.H02.1.454.CMB.2.raw
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (419)..(419): a, c, t, g, unknown or other
  misc_feature (419)..(419): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccntctcctgcactggaaccagcagtgatggttgggattatacttgtctcngtacangcacagacaacgccccaatcatgtatttagngaggctagtaacgccggcctagagggtttcagtcgtcttctctgctcgatcngcaacncgctccnanatctcgngtctcgagtcgngaggacgaggtctagtacttacgtatcgagttcgaccttnaattagtccgagtagggttagttacggttagttttcgggtaggttccggggacgggacggtaccgaaacgtccggtacgtaccgtacgtaacgggtcgaaccgtacccggtaggtcccgtccggtcccccgttacggtcctaccg

SEQ ID NO: 315583 - DNA, 749 bp, Homo sapiens
  misc_feature: GZ8MTXP02FGBTA.45.79.H02.1.454.CMB.2.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctcgtgtcgtgggtctccgnggacagtcatcacatctcngcactggaaccngcagtgatggttggattataacttgtctctagtaccaangcaccagacaaacgccccaaatcatgatttagngaggcagtaacgccgcctaggtacgggtttcaatccgtcttacctcgtcgactcctaaacggtcgtaggaccaaaccgtaccggtcctacccgtagaactaacgttcgtccgtcgggtccctacgaaggtcgtaaggacggaaacggtcgacgtttaggtaactttaacgttaacggtcggtacgttcgtaccgtacttaaacgttaagtacccgaagggttaacgggttttaaaaggtttccgggtttaaaggttttcgggggtttcggggttacccgggggtaacgggggaaacccgggtaaaccgttaaacggggtcccgttaaacgggttaacccccggtttaacgggaaccggtttaccggaaaacccggttaaaccggaaaaacccgggtttccccggtaccccggttccccccggtttaaacgggttcccctttaaacccccgggg

SEQ ID NO: 315584 - DNA, 693 bp, Homo sapiens
  misc_feature: GZ8MTXP02G9S6C.45.79.H02.1.454.CMB.2.raw
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
  modified_base (329)..(329): a, c, t, g, unknown or other
  misc_feature (329)..(329): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcacatctctgcactaggaaccngcaggtgagtggttagggattactaacttgtcctccgtacggtaccaanacgaccaacccgaggaaccaaacccgacccccaaaactcattacgtaatttagnggtacggactaaggtaacggcccggtaccctagggttacggggtttactaacgtccgtcttaccgtcgtcggtcctaccgtaagtccgtacggaccaaccggtccggtcccctcccgtaagaacctacttccgtacgtcgggccctaccgaggtcgtaggacggacggagtctagtatttacgtactcgtacgttcgtactactagtgttaccggagttaagggttaccggttaggtttacggtttaggggtcgggttaccggggtacggggtaacggacccgtaagtcccggtacgtacccggtacgttacggaccgaacgacccgtaacgtcccgtacccgtccccgtacggtactccccgg

SEQ ID NO: 315585 - DNA, 697 bp, Homo sapiens
  misc_feature: GZ8MTXP02FJ2RS.45.79.H02.1.454.CMB.2.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcacgtggaaccagcagtgatggttagggattataaccttgtctacctaggtaccaacngcacccgagacaaacnccccaaancagtntatttagngacggcgaagtaacgcgtccctagtacgggttactatcgtactccctcgtcggtacctaccgtagttccgtacggtacaaacccgtcccggcccttaccccgtgaaacctaacgttcgtccgtacggtaccctccgaaggacgtagggacgggacggtacggtccgttagtacgttaacttacgtggtactcgtacttacctagtagtacggtaccgtaaagggtttacgtttaaacggtttaccggttttaagggggttggttaaccgggggtacgggtaccggggtaaccgtaaacgtccggttaaccggtaacccgtacgggtacgtacgaaaccgtcccggtaaaccggtccgtacccggtccccggtaccgtcctttaccccgg

SEQ ID NO: 315586 - DNA, 682 bp, Homo sapiens
  misc_feature: GZ8MTXP02GJKUI.45.79.H02.1.454.CMB.2.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
tcagacgcgatcgacacgaccggtgctcgatttagtgtcacacgaagggaaaggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcacgtggaaccngcagtgatgttgggattataaccttgtctctgtacaacagcaccaggacaaacgccccaaatcatgatttagngaggcagtaacgcggtcctacgtaggggtttactaaatcgctttacctcgtggtctacaagtctacgggcctaacgacggccctcccgtagaaccaaattcctacgtgggtaccctacgacggcctaggaacgggaccgaggggtccttaggtaaatttacgttaaaccgtcggtaacgttcggtacctttaccgaattaacgttacggacgtaaaggggtttaccgttaaggtttaccgttttacggggtgggtttaaccggggacgggttaacgggggaacctaaaggtccgttacggacccgtttaccgtacggttaccgaaccggcccccgtaaaagggtccctacccggtccccccgtttacgggccctttaacccgg

SEQ ID NO: 315587 - DNA, 563 bp, Homo sapiens
  misc_feature: GZ8MTXP02GFR0Q.45.79.H02.1.454.CMB.2.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagacgcgatcgacacgaccggtgctcgatttagtgtcacacgaagggaaagggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcacatctcctgcactggaaccngcagtgatggttagggattataaccttgtctctggtacaacngcaccaggcaaacgccccaaancatgatttangaggcagtaagcggcctgtagggttcaatcgcttcnctgctcagtctggcaacncggtcctacctgacactctcgngcctcgngctgacgcgaggctgattatcgtgtactgcgttcagtagtgacgtaggttagtaagtttacggtttggtgggttacgggacgggtaaacgggaccgaaaggtcgttacggacccgttacggttacggaccaacggacccgtaacgggtcctacccggtacccccgttcgggtaaccttccccg

SEQ ID NO: 315588 - DNA, 628 bp, Homo sapiens
  misc_feature: GZ8MTXP02IFOFG.45.79.H02.1.454.CMB.2.raw
  modified_base (156)..(156): a, c, t, g, unknown or other
  misc_feature (156)..(156): n is a, c, g, or t
  modified_base (233)..(233): a, c, t, g, unknown or other
  misc_feature (233)..(233): n is a, c, g, or t
  modified_base (442)..(442): a, c, t, g, unknown or other
  misc_feature (442)..(442): n is a, c, g, or t
tcagacgcgatcgacacgaccggtgctcgatttagtgtcacacgaagggaaagggggggtcacaagaggcagcgctctcgggacgtctccaccatggcctgggctctgctgctcctcactctcctcactcaggacacaggatcgtgggccctttcngccctgactcagcctgcctccgtgtctgggtctcctggacagtcgatcaccatcggcctgcacgtggaaaccaacgngtagatggttggtagtttttagttgtctcgtgtacaacacaccccggcgaacgccccaaataatcatttagaggacactaagcggtcctcggggttcaagtcgacttctctggcctcgaagtctcgccaacgaccgtccctccctagactatcctcgtagggcctacgacggctagacggcgagctgtattatttcgtcgttagacttntatacgcgacgacggacctacgtcgttacgggttcgggttcggtacggggacggtacgggtaccggttaggttaccgaccgtccggtacggtacgaccggtaccgtacggcccgtcccgtacccggttcgtaccgtaacccgttcccgttacccgttccccctacctttcccgtaccgtccgtacg

SEQ ID NO: 315589 - DNA, 514 bp, Homo sapiens
  misc_feature: GZ8MTXP01CDPMJ.52.52.E08.1.454.CMB.2.raw
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
tcagcgcagtacgacacgaccggtgctcgatttagtcgagctctcagagagaaagggtgatcaggactcctcagttcaccttctcacaatgaggctccctgctcagctcctggggctgctaatgctctgggtcccagcatccagtgggatgttgtgatgactcagtctccactctccctgcccgtcacccttggacagccggcctcatctcctgcagtctagtcaaagcctcgcacacagtgatggaaacacctacttgaattggttcagcagagccagcaatctcaagcnctaattataagttcncacggactcctggggtccagacagaattcaagcgcagtgggtcagggcactgatttcacgctagaaatcagcagggtgaggntagaagtaggttggtttagggtttatagtgnagtgacgagcacacacgtcgcttgtacgttacgtacgtttcggaccggacgggaccaaggtcgtaagggaaggaacggaaacgtaacgttgtcgg

SEQ ID NO: 315590 - DNA, 547 bp, Homo sapiens
  misc_feature: GZ8MTXP01DQ2A3.52.52.E08.1.454.CMB.2.raw
  modified_base (286)..(286): a, c, t, g, unknown or other
  misc_feature (286)..(286): n is a, c, g, or t
  modified_base (403)..(403): a, c, t, g, unknown or other
  misc_feature (403)..(403): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctactgaatttggttcagcagagcagccaatcncaaggcactaatttataaggttctcgacggtactcgtcggggtcccccaggacagtatcaagcgcagtgggtcaggcactgtattcacgtactagaaaatcagagaagggtggaggnagaagtagttggtttaggggggtttattacgttgacagtgacgaaggacaactacaacgtcgggtccctgtacgttacgttacgttttggacccgtaggggaacccgaggacgtgggaagaaggaaacgacgttaggtggcgtg

SEQ ID NO: 315591 - DNA, 565 bp, Homo sapiens
  misc_feature: GZ8MTXP01DMPOG.52.52.E08.1.454.CMB.2.raw
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatgaaacnctactgaattggttcagcagagccaggccaatcacaaggcaccttaatttataaggttcncgaccggtactcgtcggggtcccccagacagtacttcgaagcggcgaggtgggtacagggcacgtgtactttcacgactagaaatcgaagacgaggggtggaggcgtagaagtagttgggtttaggggggtttaattacgtgacgtagtgacgaaggacacgacgtacgtcggcctgtcgttacttacgtttcgggaccggtaggggaccgaggacgtaagggaacggaacggaaacgagttggtcggcgtaacg

SEQ ID NO: 315592 - DNA, 671 bp, Homo sapiens
  misc_feature: GZ8MTXP01BZ7PX.52.52.E08.1.454.CMB.2.raw
  modified_base (243)..(243): a, c, t, g, unknown or other
  misc_feature (243)..(243): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatctcctgcaggtctagtcaaagcctcgcacacagtnataggaaactacctactgtaattggttcagcaggaggccaggccaatcctaccgaaggtcctacctttaaatttacgttaaacggttttcctaccgaacccgggtacttcggtacgggggtacccccccaaggacaggtactttcgaaacgggccgggtcgagggtggggtcagggtctacgtgtaactttcgacgtacttaagaaacttcgaaggacgagggggtggaaggtcgtagaaggtagttgggtttaggggggtttaattacgtgactagtcgacgaaaggaccacgtacgtacgtcggcctggtaccgttacgtaccggtttcgggacccgggtaacgggggaacccgaaggttccggttaaggggaacgggtaaacgggaaaacggtaaccggttgggtaacgggttaaccgtaaccgg

SEQ ID NO: 315593 - DNA, 771 bp, Homo sapiens
  misc_feature: GZ8MTXP01APUNG.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcaccttggacagccgctcatctcctgcaggtctagtcaaagcctcgcacacagtgataggaaacactactgtaattggttcagtcaggacggccgaggaccaatcctaccgaaggccgtaccctttaaagttttaacgttaaagggttttcctaccggtaacccggggtaccgttcccggttaccgggggtacccaaggaacccgtaggtaaacgtttcgaacggccgggacgtaacgggttggggtaccaacggggctaaaccgttggtaacttttaccgaaccggtacttaaacggaaaaacttccggaaaagggccgggtaaggggggttagggaaaccggggtacgttaagggtaaaacgggttaggggtttaagggggtttttacgggggttttaaatttaccgggttaggaccgttaagtacggtaacgaaacgggtccaaccaacgaacgttcggggaccttcgggtaccgttaacgttaaccggttttcggggaccccggttaagggggacccctaaagggccggttaaggggaaccgggtaaaggggaaaacccggtaaggttcgggtaaccggg

SEQ ID NO: 315594 - DNA, 541 bp, Homo sapiens
  misc_feature: GZ8MTXP01EIJQ9.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgcacacagtgatggaaacactacttgaattgttcagcagagccaggccaatctacgaaggcgtaccttaatttagtaagtttcacgaccgggactccgtcggggtaccagacagaattcaaggcggcagggtgggtacagggctaactgtatttcgacgactagaaatcgagacgagggtgagcgtagaagtaggttggtttggggtttattacgtgacagtgacaaggcacacgtacgtgcttgcgttacgtacgtttcggccgagggaccaaggcgtaaggagaggaacgtaacgttgtaacgg

SEQ ID NO: 315595 - DNA, 619 bp, Homo sapiens
  misc_feature: GZ8MTXP01B0EHZ.52.52.E08.1.454.CMB.2.raw
  modified_base (438)..(438): a, c, t, g, unknown or other
  misc_feature (438)..(438): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtctccactctccctgcccgtcacccttggacagccggcctccatctcctgcaggtctagtcaaagcctcgcacacagtgataggaaacactattgaattggttcagcagagccaggccaatctaccgaaggctaccttaatttagtaacggtttcacgaccgggtactcggtcggggtcccccaggacagtacttcgaaggccggcgagggtcgggtcagggcctacgtgtactttcgacgtactaagaaatcgaggacggaggggtaggaggngtaggaagtagtttgggtttaggggggtttattacggttgacgtagtcggacgaacggaccaacgtaccgtacgtcgggccttcggtaccgttaacgttacggtttcgggacccgggtaacggggacccgaggacggtaagggaaggtaacgggaaacggtacgttgggtcggcgtaaccg

SEQ ID NO: 315596 - DNA, 543 bp, Homo sapiens
  misc_feature: GZ8MTXP01EU9B3.52.52.E08.1.454.CMB.2.raw
  modified_base (402)..(402): a, c, t, g, unknown or other
  misc_feature (402)..(402): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgcacacagtgataggaaacactactagaattggttacagcagagccagccaatctacaaggctaccttaatttataagttcacgaccggactcgtcgggtcccccagacagtatcgaagtcgcgagtgggtcagcactgtacttcacgctagaaatcagacgagggtgagngtagaagtagttgggtttagggggtttattacgtgatagtgacgaaggaccacgactacgtcggcctgtaccgttacgtacgtttcggaccggaacggggaccttagcgtaaggagaacggaacgagttgaacggctaacg

SEQ ID NO: 315597 - DNA, 568 bp, Homo sapiens
  misc_feature: GZ8MTXP01B7F2S.52.52.E08.1.454.CMB.2.raw
  modified_base (326)..(326): a, c, t, g, unknown or other
  misc_feature (326)..(326): n is a, c, g, or t
  modified_base (387)..(387): a, c, t, g, unknown or other
  misc_feature (387)..(387): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcagtctagtcaaagcctcgcacacagtgataggaaacactacttgaatttggttcagcagacggccaggccaatctaccgaaggcgtaccttaatttagtaacggtttcncgaccgggtactccgtcggggtccagacagtattcaaggcggcaggtgggcagggcacgtntattcacgctagaaaatcgaggacgaggggtggaggacgtagaagtagggttggtttagggggtttaattacgtgtacgagtacgacgaaggtcacacgacgtcggcgttgaccgttacgtcgtttcggaccgttggggacccaagcgtaaggaaggaacggaacgtaacgttggtaacgg

SEQ ID NO: 315598 - DNA, 667 bp, Homo sapiens
  misc_feature: GZ8MTXP01A6F9F.52.52.E08.1.454.CMB.2.raw
  modified_base (347)..(347): a, c, t, g, unknown or other
  misc_feature (347)..(347): n is a, c, g, or t
tcagcgcagtacgacacgaccggtgctcgatttagtcgagctctcagagagaaagggcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgcacacagtgatggaaacactactgaattggttcagcagagcaggccaatctcaaggcgtaccttaatttataacggttttcacacgagggactcgtcggggtccccaggacaggtnttacgagtcgggctaagggtcgggtcagggtcaacgttggtaactttccgaacgtcgttaagaaaacgttccgaaggccgtaagggggttacgggaagggtacttaggaaaggtagttggggtttaggtaagggtttttaattacgtagtacgtaagttggaaccgaaagggtcccaaacgtaccgtaaccgtcgggtaacccgttgggtaccgttaacgttaaccggtttttacggggaccccgttaagggggaaccccgtaagggccggttaagggggaacggtaacggggaaaacgtaacgttaaccgggttcgggg

SEQ ID NO: 315599 - DNA, 650 bp, Homo sapiens
  misc_feature: GZ8MTXP01A31VH.52.52.E08.1.454.CMB.2.raw
  modified_base (250)..(250): a, c, t, g, unknown or other
  misc_feature (250)..(250): n is a, c, g, or t
  modified_base (514)..(514): a, c, t, g, unknown or other
  misc_feature (514)..(514): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtcctccactcctccctcgcccgtcacccgttggacacgcccggcctccatctcctgctaggtctagtcaaagcctcgcacacagtnatacgaaacactacttgaatttggttacagtcaaggacggacccaaggaccctaaactccgtaacccgaaacggtccgtaacctttaaagttttaagttaaacggttttccacggtaaccccgggtactccggtacgggggtacccccccaaggacgtaagtacgttccgaaacgggtccgggtcgtaggggtacggggtacaacggggcctacgtaggttacttacgacgtacgtaagaaactcgaggacggaggggtggagngtagaaagtgttagggtttagggggttaattagtgactagcgacgaaggcacacgacgtcgctcgcgttacgtacgttcggacccgtaagggaccgagcgtaagggaagaacggaaacgagttgtaacggctaacg

SEQ ID NO: 315600 - DNA, 591 bp, Homo sapiens
  misc_feature: GZ8MTXP01BTF9V.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctactgaatttggttacagcaggacggccaggccaatctaccgaaggcgtaccttaatttagtaacggtttcacgaccggtactcgtcggggtacccccagacagtattcgaacggcggcagggtcgggtcagggcctacgtgtactttcacgtactaagaaatcgagtcgaggggtgagggctagaagtagttagggtttaggggggttttattaacgtgacgtagtcggacgaggccaacgtacgtacgtcgtaccgtcgtacgttacgtacgtttcgggaccgtagggttaccgaggcgtaaggaggaacggaaacgtacgttaggtcgcgtaacg

SEQ ID NO: 315601 - DNA, 597 bp, Homo sapiens
  misc_feature: GZ8MTXP01CPT2C.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggctccatctcctgcaggtctagtcaaagcctcgcacacagtgataggaaacacctacttgaattggttacagcagagccaggccaatctacaaggcacctaatttataaggtttctacgacgggactcgtcggggtaccccccaggacagattcaagcgcaggtgggtacaggcacgtgtattcacgctagaaatcagcgagggtgaggctagaagtagttggttaggggggtttaattacgtgacgtaagtcgacgaaggcaacgtaccgaacttcgggcccttaaggtccgttaacgttaccgttttgggaccccgtaagggggttaaccccaaggttacccgttaaggggaaaggaacgggtaaaaccgaacgttcgggttaagggcttaaccgg

SEQ ID NO: 315602 - DNA, 663 bp, Homo sapiens
  misc_feature: GZ8MTXP01C9DTU.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactcctccctcgcccgtcacccttggacacgcccggcctccatctcctgcaggtctagtcaaacgcctcgacacacagtgataggaaactacctacttgaatttggttacagcaggaggccaggcccaatcctaccgaaggccgtaccttaatttacgttaacggtttcctacgacccgggtactcggtcggggtacccccaggacagtatcgaaggcggcgaggtcggggtacagggtcctacgttgtactttacgacgtactaaggaaaactcgaaggacggtaggggtaggaggacgtaggaaggttagtttagggttttaggggggtttaacttacggtgtacgtagtcgacgaaggaccaacgacgtacgtcggtcccgtaagtccgttacgttacggtttcggaaacccggtaggggttaaacccgaggttaccggtaaggggaaaggaacgggtaaaaccggtacggttagggtcggttcgtaaccgg

SEQ ID NO: 315603 - DNA, 743 bp, Homo sapiens
  misc_feature: GZ8MTXP01EHG3R.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtctccactcctccctcgcccgtcacccgttggacacgcccggcctccatcctcctgcaggtctagtacaaacgccctcgacacacgagtagatacggaaaacctacctacttagtaatttggttacagacaggacggaccacggacctaatcctaccgaaacggtacctacctttaaagtttacgttaaacggttttcctaccggtacccgggtactccggtacgggggtacccccccaaggaacgaacgtacttaccgaaacgggccgggtcgtaaggggttcgggaccgaacgggtacctaagttcgtaactttcgaacgtacgtaaagaaaacgtcgaagacggtaagggggtggaaggtacgtagtaaaggtagtttaggggttttaggggggttttaattacggtgacgtagtgaacgaaggaccaacgtacgtacgtcggtcccgtaaggtacccgttacgttacccggttttcgggacccggtaacgggggaacccttaagggttaccggtaagggggaaaacggaaacgggtaaaaccggtaggttacggtaaccgggttaacgtaaccgg

SEQ ID NO: 315604 - DNA, 546 bp, Homo sapiens
  misc_feature: GZ8MTXP01DGNZO.52.52.E08.1.454.CMB.2.raw
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgagtcccagcatccagtggggatgttgtgatgactcagtctccactctccctgcccgtcaccttggacagccgctccatcctcctgcaggtctagtcaaagccctcgcacacagtgataggaaacacctacttgaatttggttcagcagagccaggccaatctacgaaggccgtaccttaagtttataaggtttccncgacccgggtactcgtacggggtcccagacaagattcgagcggnaggtgggtcagcactgtattcacgctagaaaatcagcgagggtggagtacgtaggaaggtagtttggtttagggtttatacgtgcagtagacgaaggcaacacaacgtcggcctgacgttacgtcgtttacgggccgttaggggaaccagcgtaggacgaaggtaacgaacgtggg

SEQ ID NO: 315605 - DNA, 591 bp, Homo sapiens
  misc_feature: GZ8MTXP01EBDQD.52.52.E08.1.454.CMB.2.raw
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
tcagcgcagtacgacacgaccggtgctcgatttagtcgagctctcagagagaaaggggcaggactcctcagttcaccttctcacaataaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacactactgaattggttcagcagaggccaggccaatcncaagcgacttaatttataagtttcncgaccggtactcgtggggtcccagacagattcgaggcgcnggtgggtcagggcactgatttcagactagaaatcaggcgaaggggtgaggcgagaagtagttggtttaggggtttacttacgtgacgtaagtgacgaacggcaacacgtacgtcgggtccctggtccgttaacgttacggttttacgggacccggtaacgggggaacccttaagggccggttaggggaagggaaaacgggaaacggtaaccgtgggttacgggtccttcgggtaacccg

SEQ ID NO: 315606 - DNA, 614 bp, Homo sapiens
  misc_feature: GZ8MTXP01AK5LT.52.52.E08.1.454.CMB.2.raw
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagaggccaggccaatctcaggcgcttaatttataaggtttcncgaccgggactcgtcggggtccccccagacagattccaagccggnaggtgggtcagggctacgtgtattcacgctagaaaatcagcgagggtggaggtctagaagtagttgggtttggggggttttaacttacgtgtactagtcggacgaaggacaacaacgtacgtcgggcccttggtccgttaaccttacggttttccgggacccggtaaacgggggacccgttaaagggttcccgttaagggggaaacggaacgggtaaaaacccggtaccggttagggtaacgggttcccgtaaggg

SEQ ID NO: 315607 - DNA, 593 bp, Homo sapiens
  misc_feature: GZ8MTXP01D53GT.52.52.E08.1.454.CMB.2.raw
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccaggtggggatgttgtgatgactcagtcctccactcctccctcgcccgtccaccttggacacgccgcctccatctcctgcaggtctagtacaaagcctcgacacacagtgataggaaactactattgaattgttcagnagagcagcaatcacagctacttaatttatagttcncgacggtactccgtcgggtaccagacagtaacttcgaaggcgacgtagggtcgggtacgaggctacgtgtacttacgacgtactaagaaactacgagacggaggggtaggacggagtaaggtaaggttaggggtttaggggttttaggggtttaacttacgtgacgtagtagacgaacggtacacgtacacgtcgtaccgttcggtacgttacgtacggtttacggaccggttacgggaaccaaggacgtgggaagaaggaaacgtaagttggtaacg

SEQ ID NO: 315608 - DNA, 635 bp, Homo sapiens
  misc_feature: GZ8MTXP01DA7UL.52.52.E08.1.454.CMB.2.raw
  modified_base (204)..(204): a, c, t, g, unknown or other
  misc_feature (204)..(204): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
tcagcgcagtacgacacgaccggtgctcgatttagtcgagctctcagagagaaaggggtgatcaggactcctcagttcaccttctcacaatgaggctccctgctcagctccgtggggctgctaatgctctgggtcccagcatccgaggtggggattgttgtgatgactcagtctccactcctccctcgccgtcacccttggacngcccgcctcatctcctgctaggtctagtacaaacgcctcgcacacagtagatacggaaacctaccttattgaagtttggttacagcagacggccaggaccaagtcctacgaaggtcgtaacctttaaagtttacgttacggtttctacgaccgggtcttccggtcggggtaccagtacagtacttacgnggcggngtagggtggcaggtcacgtgtacttcgacgtactaagaaactgacgcggtaggggtaggagtgtaaggtaaggttaggggtttaggggttttaggggtttaacttacgtgacgtagtacggaacgagtccaacgacgtacgcggtacgttcggtacgttacgttaccggtttcgggaccgttaggggaaccctaagggtcgaagggaacggaacggttaacgtaacgttggtaacg

SEQ ID NO: 315609 - DNA, 582 bp, Homo sapiens
  misc_feature: GZ8MTXP01D2ABT.52.52.E08.1.454.CMB.2.raw
  modified_base (296)..(296): a, c, t, g, unknown or other
  misc_feature (296)..(296): n is a, c, g, or t
  modified_base (419)..(419): a, c, t, g, unknown or other
  misc_feature (419)..(419): n is a, c, g, or t
  modified_base (566)..(566): a, c, t, g, unknown or other
  misc_feature (566)..(566): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtcctccactcctccctcgcccgtcacccttggacacgcccggcctccatctcctgcaggtctagtacaaagcctcgcacacagtgataggaaacactacttgaatttggttacagcagagccaggccaatcncaaggcacttaatttataaggttcacgaccggtctcgtcggggtcccccagacagattcgaagcgcgagtgggtcagggcactgtactttcacgtactagaaaactcgagacgagggtggagngtagaagtagttagggtttagggggtttaacttagtagtactagtggacgaaggtacaacgactacgtcggccttggccgttaacgttcgtttacgggaccgtaaggggacccgaaggccgtaagggaagtaacggaaacgtaacgnggtaagggctaaccgg

SEQ ID NO: 315610 - DNA, 722 bp, Homo sapiens
  misc_feature: GZ8MTXP01B2SKL.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccaggtggggatgttgtgatgactcagtcctccactcctccctgcccgtcaccttggacacgccgcctcatctcctgcagtctagtcaaagcctcgacacacagtgataggaaacactacttgtaattggttcagcagaggccaggccaatctaccgaaggtccgtaccttaaagtttacgttaacggtttctaccggaccgggtactccggtcggggtaccaagaccagtaacttcgaacggtcggccgtaagggtcgggtacgagggtactacgtagttactttccgaacggtcgtaagtaaaagtccgaaggtccgggtaagggggtggtaacgggacttaagggtaaaaggttggggttttaggggttttaaggggggtttttaaacttaaccggttaggtacctaaggttagaaccggtaacgggtaccaacgtaccgaacggttaacgggtccgttacgggtaccgttaacggttaaccggttttcggggaacccgggttaaccggggaaccgtaaggaccgggtaaggggtaaacggaaacggggttaaaacccgtaaggttccgggtaacggg

SEQ ID NO: 315611 - DNA, 725 bp, Homo sapiens
  misc_feature: GZ8MTXP01BCG6W.52.52.E08.1.454.CMB.2.raw
tcagcgcagtacgacacgaccggtgctcgatttagtcgagctctcagagagaaaggggcaggactcctcagttcaccttctcacaatgaggctccctgctcagctccgtggggctgctaatgctctgggtcccagcatccaggtggggatgttgtgatgactcagtctccactctccctgcccgtcacccttggacacgccgcctcatctcctgctaggtctagtcaaagtcctcgacacacagtgagtacggaaacctacctacttagtaagtttggttcagcaggacggccaaggaccctaaatcctaaccgaaaggcctaacctttaaatttacgtaaacggttttccacgtacccggtactcggtcggggtaccccccaaggactagtaacttcgaaacggccggcgtagggtcggggtacaacgggctaacggttgtaactttacgaacgtactaaggaaaactcgaaggacggaggggtaggacggacgttaggaagttaagtttggggtttaacggggggtttaattaacggttgtaccgtaagtacgaaccgaaggtaacccaacggtacctaaccggtcgggtcccttaacggtaccggttaaaccgttaccggttttcgggaaacccggtaacgggggttaaacccaagggttaccgtaagggaaacggtaaacgggaaaaccgtaacggttgggtaacggttaaccgtaaccgg

SEQ ID NO: 315612 - DNA, 771 bp, Homo sapiens
  misc_feature: GZ8MTXP01A7PU3.52.52.E08.1.454.CMB.2.raw
  modified_base (241)..(241): a, c, t, g, unknown or other
  misc_feature (241)..(241): n is a, c, g, or t
  modified_base (346)..(346): a, c, t, g, unknown or other
  misc_feature (346)..(346): n is a, c, g, or t
tcagcgcagtacgacacgaccggtgctcgatttagtcgagctctctcggcgggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatattctgtactaaaaccgtttntgtacttagtcggaccagacgaagacgccgacggccgacggtccctgttggtggtagtatataagtaaggacagtagacgacgtcccgtacgacgggtactccgngacgcgtacttcgtccgtcggtctacccgtaccgtacggaaacgggacctaacgtacgtaccgtaccgttacgacctacgtacgtacggtacggacgtaccggacgggtacgaacgggaacgggaaccggtacggtaccgtaacggtaacccgtaacccgtaacggttacgtaacctaaacggtaaacgaaacggaaccggaaccggtaacggtaccgttaagggtttaccgggttttaacgtttacggttaccggtttaccgttacccggtaacccggttaaaccgggttaaccggggttaaacccggttaacgggttaccccgtaacccgggttacccgttacggttacccgacccggaaccccgtaacccggtaacccccgtaaccccgtaccgttaccgtaaccccgttaaccgtttcccg

SEQ ID NO: 315613 - DNA, 606 bp, Homo sapiens
  misc_feature: GZ8MTXP01EY7YY.52.52.E08.1.454.CMB.2.raw
  modified_base (318)..(318): a, c, t, g, unknown or other
  misc_feature (318)..(318): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtctccactcctccctgcccgtcacccttggacacgcccggcctccatcctcctgcaggtctagtcaaagcctcgcacacagtgataggaaacactacttgaattggttcagcagacgcagccaatcacgaggctacttaatttataaggtttcncgaccggtctcgtcgggtcccccagacagatcgaagcgcgaggtgggtcaggcacgtgtactttcgacgtacgtaagaaactcgaaggtacggaggggtaggagggatagggtaagtagttagggtttaggggggttttaattacggtgtacgtagttcggacgaacggaccaactacgacgtcggtccgtggtaccgttaccgtacgtttacgggaccggtaacggggaccgttaaggcgtaacggggaaggaaacggaaaccggtaagttcggtcggcgtaaccgg

SEQ ID NO: 315614 - DNA, 594 bp, Homo sapiens
  misc_feature: GZ8MTXP01AFHYO.52.52.E08.1.454.CMB.2.raw
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactcctccctgcccgtcacccttggacacgccgcctccatctcctgcaggtctagtacaaagcctcgcacacagtgataggaaacactacttgaattggttcagcagagcagccaatcacagcaccttaatttataaggtttcncgaccggtactcgtcgggtccccagacagatcgaaggcggcgtaggtcggggtcacgggctagtacgtactttccgacgtacctagaaaactnaggacgtaggggtaggaggtacgtaggaaaggtgtttagggttcggggggtttaatacgtgtacgtagtcgaccgaaggaccacgaaccgtcgtccggtaccgtcgtacgttaccgtacgtttcgggaccgtaacggggaccgaagttcgtaagggacgtaacggaacgtagttcggtaacgcgtaacg

SEQ ID NO: 315615 - DNA, 827 bp, Homo sapiens
  misc_feature: GZ8MTXP01C7Z91.52.52.E08.1.454.CMB.2.raw
tcagcgcagtacgacacgaccggtgctcgatttagtcgagctctcagagagaaaggggtgatcaggactcctcagttcacattctcacaatgaggctccctgctcagctccgtggggctgctaatgctctgggtcccagcatccgaggtggggattgttgtgatgactcagtctccactcctccctgcccgtcaccttgacacgccgcctcatctctgctagtctagtacaaacgtcctcgacacacgagtgagacggaaactaccttacttagtaagtttcggttacagacgaaggacggacccaacggaccctaaacttccgtaacccggaaacggtcccgtttaaaccctttaaaagtttttaacgttaaacggttttaccgtacccggtaaccccggggtaaccccgttcccgggttacgggggtacccccaaaggtaacccgtaaacgggttaacgtttaacccggacggggtacccgggtaccggtaaacggggttcggggtaacccgagggtaccctacgtttaggtaactttccgaaacggtacgttaaacgaaaacgttccggaaggaccgggttaagggggtacgggacggtacgttaagggtaaaggggttagggtttttaggggttttaggggtttttaactaccgttagaccgtaaggttacggaaccgtaaacggaccaaaccgtaaccgtaacgtcggttccgttacggttacccgtttaaccgttacggtttaccgggaccggaaacggggtaacctaagggtaacgttaaggggaaacggttaaacgggtaaacgttaacgttaacgggg

SEQ ID NO: 315616 - DNA, 682 bp, Homo sapiens
  misc_feature: GZ8MTXP01A0CQI.52.52.E08.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatcctcctgcaggtctagtcaaagcctcgcacacagtnatggaaacncctacttgaattggttcngcagaggcccaggaccaactcctaccgaacgggtccgtactttaaattttagttaaacggtttcctaccggtacccggggtacttcccggttaccgggggtaccaacgaacgacgttaacttaccggaaggccgggaccgtaggggttccgggacaggggacctacgttacggttatttaccgacgtacgtaacgtaaaactcgaacggtcggaaggggttgggacggtacgtaggtaaaggttaggggtttaggtttagggggttttaattaaccgtgtcaagtcgacgaaggtccaaccgaacctggtaacgtccttggtaccgttaccgttacgtttcggaccgggacgggacccgtaagccggtaagggaacggaacgggttaaacgaacgttaacggtcggg

SEQ ID NO: 315617 - DNA, 562 bp, Homo sapiens
  misc_feature: GZ8MTXP01ADDSF.52.52.E08.1.454.CMB.2.raw
  modified_base (323)..(323): a, c, t, g, unknown or other
  misc_feature (323)..(323): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctcatctcctgcaggtctagtacaaagcctcgcacacagtgataggaaactacctacttagaatttggttcagcagaggcaggccaatctcgaagcgtacttaatttagtaagtttcncgacggtactccgtcggggtccaggaccagaattcgaagcggacgaggttcgggcagggctactgtattacacgactagaaatcgagngtagggngagtgtagagtaggttggttaggggtttatacgtgacngtacgacgaaggccacgacgtagtcggcttggtaccgttacgttacgtttacggaccggacgggaccaaggcgtaagggagaacggaaacgtccgttaagggccgg

SEQ ID NO: 315618 - DNA, 808 bp, Homo sapiens
  misc_feature: GZ8MTXP01B8OBK.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacacgcccggcctccatctcctgcaggtctagtcaaagccctcgcacacagtgataggaaacacctactagtaattggttacagcaggacgccaggcccaatcctaccgaagggtcctacctttaaattttagttaacggtttcacgacgtagggtacctcgtccgggggtacccagacgagtattacgaggtcggacgtagggttcgggtaccgagggcctaacgtaggttacttttaccgaacggtacgttaaagaaaaacgttccggaaagggtaccgggtaaggggggttagggaacgggtacggttaaagggtaaagggttaggtttagggggttttaggggtttaaggggttttttaaacgttacggtttacggacgttaacggttaggtaacccggtaaacggggtacccaaacccgtaaccgttaaaccgggttccgggtaccccgtttacgggttaccccggtttaaaccggtttaacccgggtttttaccgggggaaccccgggttaaacggggggttaaaccccgttaaacggggaccgggttaagggggaaaacgggggtaaccggggaaaaacggttaacccggttaagggggttaacccggg

SEQ ID NO: 315619 - DNA, 613 bp, Homo sapiens
  misc_feature: GZ8MTXP01CAXA1.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcagtctagtcaaagcctcgcacacagtgataggaaacactactgaattggttacagcagagccaggccaatctaccgaaggcgtaccttaaatttagttaacggtttccacgaccggtctcgtcggggtaccccccagactagtacttcgaaggcggcgtagggtcggggtcagggctacgtgtactttcgacgtactaagaaactcgaggacgtaggggtgaggacgtagaagtagttagggtttaggggggtttattaacgtgtacgtagtgcgaaggacaacgtacgtacgtcggcctggtaccgttacgttacgtttaccggaccggtaacggggaacccgaggacgtaacggggaaaggaacgggtaaacgtacggttaggtcggttcgtaaccgg

SEQ ID NO: 315620 - DNA, 878 bp, Homo sapiens
  misc_feature: GZ8MTXP01A5SLI.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtcctccactcctccctcgcccgtcacccttggacacgccgcctccatctcctgcaggtctagtacaaagcctcgcacacagtgatacgaaacacctacttgaatttggttcagcgaggacggccaggaccaatccgtacgaacggccgtaacctttaaatttacgttaaacggttttcctaccggtaacccggggtacgttcccggtacgggggtaccccccaacggtaacgtacggtacgttacccgaaacgggtacccgggtaacctaaagggttccgggggtaccaacggggacccttacgttagggttaacctttaccgaaccggttaccttaaagggaaaaacttcccggaaagggtaccgggtaaaggggggttacgggaaccggggttacgttaaaggggtaaagggtttaacgggtttttggggggtttttaaaggggggggttttaacctttacggggttaggacccgttaaggttaacccgggacgtaaaccggggaccctaaccgaaccccggttaagtcccgggggttacccttaacgggttaaccccggtttaacccgggtttaacccggttttaccgggggaaaccccgggtaacggggggttaaaccccgaagggttacccgggtaaagggggtaaaacggggaaaaccggggttaaaaccccggtaggtttccggggaaccgggttcgtaaccccggg

SEQ ID NO: 315621 - DNA, 636 bp, Homo sapiens
  misc_feature: GZ8MTXP01EQNNH.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtctccactcctccctgcccgtcacccttggacacgcccggcctccatcctcctgcaggtctagtacaaacgcctcgcacacagtgagtaggaaactacctatgtaattggttacagcaggagccaggccaatcacgaagctacttaatttagtaagtttcacgaccggtctcgtcgggtaccccagacagtactcgaggcgcgtagggtgggacagggcctacgtgtactttcgacgtactaagaaagtcgaggtacggtagggggtaggacggtcgtaaggtaagttaggttgggtttaggggggtttaacttacggtagacgtagtacgacgaacggtaccacgtacgtacgtcggtcctcggtacgttacgtacgtttcgggaccggtaacggggaacccgaggttaccggtaaggggaaagggtaacggtaaaaccggaggttacgggtaaccggttaacgtaaccgg

SEQ ID NO: 315622 - DNA, 711 bp, Homo sapiens
  misc_feature: GZ8MTXP01CIKCD.52.52.E08.1.454.CMB.2.raw
  modified_base (220)..(220): a, c, t, g, unknown or other
  misc_feature (220)..(220): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactcctccctcgcccgtcacccttggacacgccggcctccatcctccngcagtctagtacaagcctcgcacacaggtgaatacggaaactaccttattagtaatttggttcagacaggacggccaggaccaactcctaccgaagggtcctaacctttaaagtttacgttaaacggtttccaccgtaccggggtacttccccggtacggggtaccaagactaggtaacttacgaacgggcgtaaccggtagggtcgggtacgacgggtcctacgttagtaactttaccgacgtaccgtaagaaaagttcccgaaggtacggtagggggtagagacgtaggtaaggttagggtttagggtttaggggtttaactacggtgaacgtgtacggacgaaacggtcaacctacgtacggtcggtcgttcgggtaaccgttacgttaccggtttacgggaacccgggttacggggttaacccgaaggggttacccggtaacgggtaaaggaaccggggttaaacgtaacggttcggggtaacccgg

SEQ ID NO: 315623 - DNA, 685 bp, Homo sapiens
  misc_feature: GZ8MTXP01BRSW0.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctggtcccagcatccagtgggatgttgtgatgactcagtctccactcctccctcgcccgtcaccttgacacgccgcctcatctctgcaggtctagtcaaacgcctcgacacacagtagagtacgaaactacctacgttagtaagtttcgttacagacgacggacggaccgaacggacctaactaccgtaccgaacggtaccgtaacttttaaagtttaacgttaacggtttccaccgtaccggtacgttcggtccgggtacccccagtacgagtacgttacgaacggcgcgtacgggtcgggacaggactacgtgtacttacgacgtacgtaaagtaaactcgacggacggtaggggtaggaacgggtacgtaaggtaaaggttaggttttaggggtttagggggttttaacttacggtcgtacgtaagtacggaacgtaacggaccaacgtaccgacggtaccgtcgtaacggtaccgttacgttacgtttcggaccggtaacgggttacgaggttacgtaagggaagtaacgggaacgtaacgttggtcgttcgtaaccg

SEQ ID NO: 315624 - DNA, 558 bp, Homo sapiens
  misc_feature: GZ8MTXP02JLQ1Z.52.52.E08.1.454.CMB.2.raw
  modified_base (351)..(351): a, c, t, g, unknown or other
  misc_feature (351)..(351): n is a, c, g, or t
tcagcgcagtacgacacgaccggtgctcgatttagtcgagctctcagagagaaagggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagagccaggccaatctccaaggcgacctaatttataaggtttctcaccggtactccgtggggtcccagacagattcngcgcagtggtcaggcactgatttcacgctagaaaatcgagcgaggggtggaggcgtaggaagtagttggtttagggggtttattacgttggactagtacgacgaaacggcaaccgacgaacgtcgggtaccctggtccgtaacctacgttttccggaccgtaacggggacccaaaggcgtaggaggaaggaaacgaacgtggtacgg

SEQ ID NO: 315625 - DNA, 535 bp, Homo sapiens
  misc_feature: GZ8MTXP02G5OG7.52.52.E08.1.454.CMB.2.raw
  modified_base (255)..(255): a, c, t, g, unknown or other
  misc_feature (255)..(255): n is a, c, g, or t
  modified_base (389)..(389): a, c, t, g, unknown or other
  misc_feature (389)..(389): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacncctacttgaattggttcagcagagccaggccaatctccaaggcacctaatttataaggtttctcgaccgggactccgtggggtcccagacagattcagcggcaggtggtcaggcatgatttcacgctagaaatnagcgagggtgagcgtagaagagttggttaggggtttattacgtgacgatgacgaaaggcacacgactcggcctgacgttacgtacgttttacgggaccgtaggggacccaaggcgtaggaggaacggaaaacgaacgtaggtacgg

SEQ ID NO: 315626 - DNA, 599 bp, Homo sapiens
  misc_feature: GZ8MTXP02HNYDI.52.52.E08.1.454.CMB.2.raw
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
tcagcgcagtacgacacgaccggtgctcgatttagtcgagctctctcgctggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagattattctgtcaaaaccgtttntgtcttagtgacagcagacgcagccacgcctgtgtgnatatataagacangagacgcctgaggctccgtgacgcgtattcccgtcgtcgcctacctaccgtcgaacgggtacctacgttacgtaccgtacgttacgaacctacgtacgaggtacggacgtaccgaggacgaaggacggacggacggacgtacgacctaaccgacgtacgtaactaaactacaaacaacgaactacgacgtaggttcgtttacttagttcgttacgttacgacgtaacggtacggaaacctaacggtacctaccgtacgtacgtaccgaacgacccgaaccggacccaacccgtcgtaccgtacctaccg

SEQ ID NO: 315627 - DNA, 541 bp, Homo sapiens
  misc_feature: GZ8MTXP02IZG9I.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaatttggttcagcagaggccaggccaatctccaaggcgtacctaatttataaacggtttctcaccgggactccgtggggtccccagacagacttcaggtcggcaggtgggtcagggcactgtatttcacgactagaaatcagcagggtaggaggcgtagaagagtggtttggggttattagttgcgtatgacgaaggcacgacaacgtcggcctgacgtactacgtttcggaccgtacgggacaaggtcgtaggacggaaggaaacgacgtagtacgg

SEQ ID NO: 315628 - DNA, 535 bp, Homo sapiens
  misc_feature: GZ8MTXP02IXWX3.52.52.E08.1.454.CMB.2.raw
  modified_base (351)..(351): a, c, t, g, unknown or other
  misc_feature (351)..(351): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacactacttgaattggttcagcagagccagccaatctcaaggcgacctaatttataggtttctcgaccggtactccgtcggggtcccagacagacttcngcgcaggtggtcgaggcactgatttcacgctagaaatcgagcgaggggtgagcgtagaagtagttggtttaggggtttattacgtgcgtagtgcgaaggcaacacgacgtcggcctgacgtacgtacgtttcggaccgtacgggaccaaggcgtagggaacgaaggaaacgtaacgtggtacgg

SEQ ID NO: 315629 - DNA, 551 bp, Homo sapiens
  misc_feature: GZ8MTXP02IMBVL.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccacctcctgccaggtctagtcaaagccctcgcacacagtgatggaaacacctacttgaattggtttcagcagaggccaggccaatctcaaggcgctaatttataaggtttctcaccgggactcgtggggtcccagacagattcagcggcaggtggtcaggcacgtgatttcacgctagaaaatcagcgagggtggaagctagaaagtgtggtttaggggtttaatacgttggctagtgacgaaggcacacacttggcctggaccgtactacgttttcggacccgaggggaccctaaaggtctagggaaagaacggaaaacgtaacgtaggtcggacgtacggaaccg

SEQ ID NO: 315630 - DNA, 522 bp, Homo sapiens
  misc_feature: GZ8MTXP02J0ZGO.52.52.E08.1.454.CMB.2.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagaggccaggccaatctcaaggcncctaatttataaggtttcncaccgggactcgtggggtcccccagacagattcagcggcaggtgggtcaggcactgactttcacgctagaaaatcagcgagggtggaggctagaagagtggttaggggtttattacgtgacgatgacgaaggcacacacgtgcctgcgtacacgtttggccgacggggaccaagcgtaaggaggaacggaaacgacgtagtggcgtcg

SEQ ID NO: 315631 - DNA, 594 bp, Homo sapiens
  misc_feature: GZ8MTXP02GKAIB.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatcctcctgcaggtctagtcaaagcctcgcacacagtgatggaaacacctacttgaattggttcagcagaggccaggccaatctaccgaaggcgtaccttaatttagtaaacggtttctaccgaccggtactcgtcggggtacccccagacagattcaggcgcaggtgggtcaggcctacgtgtatttcacgctaagaaaactcgaagacgaggggtaggaggtcgtagaagtagttgggtttaggggttttattacgtgacgtagtagacgaaggcaacgacgacgtcggtacctggtaccgttacgttacgtttacggaccgaacggggaaccgaacggtcgtaagggaacggaaacggaaaacggtaactacggtacggcgtacgg

SEQ ID NO: 315632 - DNA, 524 bp, Homo sapiens
  misc_feature: GZ8MTXP02FQKA4.52.52.E08.1.454.CMB.2.raw
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
  modified_base (497)..(497): a, c, t, g, unknown or other
  misc_feature (497)..(497): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacncctacttgaattggttcagcagagcaggcaatctacaggcacctaattataagtttcncgacggactcgtcgggtcccagacagattcagcgcaggtggtacaggcactgtattcgacgctagaaaatcagacaggggtggagntaggaagtagttggtttaggggtttattacgtgacagtagacgaaggcaacgactacgtcggcctgacgtactacgtttcggaccgagggaccaaggngtaggacgaacggaaacgacgtggtcg

SEQ ID NO: 315633 - DNA, 546 bp, Homo sapiens
  misc_feature: GZ8MTXP02GACHO.52.52.E08.1.454.CMB.2.raw
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacncctacttgaattggttcagcagagccaggccaatcncaaggcgacctaatttataaggttctcaccggatcgtggggtccccagacagattcagcgcagtggtcagcactgattcacgctagaaaatcaagcgagggtggaggctagaagagttggttaggggtttattacgtgacgtagtagacgaaggacaacacgaacgtgggccctgaccgtactacgttttcggaccgacgggggaacccaaggtaccgtaaggaaggaacggaaaacgaacgtaggtcgggtactacgg

SEQ ID NO: 315634 - DNA, 584 bp, Homo sapiens
  misc_feature: GZ8MTXP02H5SSO.52.52.E08.1.454.CMB.2.raw
  modified_base (253)..(253): a, c, t, g, unknown or other
  misc_feature (253)..(253): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtgggatgttgtgatgactcagtctccactcctccctgcccgtcacccttggacagccgcctcatctcctgcaggtctagtcaaagcctcgcacacagtgatggaaacncctacttgaattggttcagcagagccaggccaatctacaaggctacttaatttataaagtttcncgaccggactccgtcggggtccagacagtattcngcgnaggtggtcaggcactcgattcacgctagaaatcagcgagggtggagcgtaggaaagtagttagggttttaggggtttaagttacgtcggtatagtggacgaagggacacgactaacgtcggaccgttacggtaccgttaaccgtacgttttacgggacccggtaacgggggaccgaaacggtaccggtaagggaacggaaagggaaaaccgtaacggtacggtaacggg

SEQ ID NO: 315635 - DNA, 579 bp, Homo sapiens
  misc_feature: GZ8MTXP02JX2B3.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagaggccaggccaatcacgaaggcaccttaatttataacggtttcacgaccgggtactcgtcggggtccccccagacagtattcgaggcggcaggtggggtacagggcacgtgtattcgacgtctagaaatcagacgaggggtggaggacgtagaagtagttaggtttaggggtttattacgtagtacgtagtcgacgaaggacgacaacgtacgtacggccgtcgtacgtacgtacgttttcggaccgtacggggaaccgaacggtacgtaaggaggaacggaaaccgaagtcggtacggcgtacgg

SEQ ID NO: 315636 - DNA, 565 bp, Homo sapiens
  misc_feature: GZ8MTXP02G3DGJ.52.52.E08.1.454.CMB.2.raw
  modified_base (252)..(252): a, c, t, g, unknown or other
  misc_feature (252)..(252): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacncctattgaatttggttcagcagagccagccaatctaccgaagcacttaaatttataaggtttctacgaccgggtactcgtggggtccccagacagattcgagcggctagtgggtcaggcactgactttcacgctagaaaatcgagcgaggggtgaggctagaagtagttgggtttaggggtttattacgtggatagtagacgaaggacaacgacacgtcggccgtcgtacgttacgtacgtttcggaccggacggggacccgaaggtacgtaagggaacggaacggaaaaccgaagttcggtacgacgtacgg

SEQ ID NO: 315637 - DNA, 574 bp, Homo sapiens
  misc_feature: GZ8MTXP02I5ZIS.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctacttgaattggttcagcagagccaggccaatctaccaaggcgacctaatttataaggtttctcgaccggactcgtcggggtcccccagacagacttcacggcggcgaggtcgggtcacgggctacgtgtatttcacgtactagaaaatcgagtacgaggggtggaggacgtagaagtagttggtttaggggtttattacgtgacgtaagtgacgaaggcacgacacgtcggtcctgtcgtacctacgttttacggaccggtacggggaccgaagtacgtaaggaaggaaaggtaaaacgtaacgtggtacggacgtacg

SEQ ID NO: 315638 - DNA, 580 bp, Homo sapiens
  misc_feature: GZ8MTXP02JNGXM.52.52.E08.1.454.CMB.2.raw
  modified_base (323)..(323): a, c, t, g, unknown or other
  misc_feature (323)..(323): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctacttgaattggttcagcagagccaggccaatcctacaaggcgtaccttaatttataaggtttcncgaccgggtatcccgtggggtcccagaccagtacttcagcggctaggtcggggtcaagggctactagtactttcacggtctagaaaactcgacggacgaagggggtggagggtcgtaggaaaggtagttgggtttagggggtttaacttagttagctagtcgacgaaggcacacacgtcggccgtgaccgttacgtccgtttcggaccggtacggggaccaaggcgtacgggagaacggtaaacgaacgtcggtcgg

SEQ ID NO: 315639 - DNA, 573 bp, Homo sapiens
  misc_feature: GZ8MTXP02GIFCM.52.52.E08.1.454.CMB.2.raw
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatcctctgcaggtctagtcaaagcctcgcacacagtgataggaaacactactgaattggttcagcagagcagccatctcaaggcgacttaattataaaggttctacgaccggctcgtcggggtcccccaagaccagattcgagcgcgagtgggtcacggcactgtactttacgacgtaccgtaagaaaactcgaagacgaggggtaggaggcgtaggaagtaagttgggttaggggtttaattagtgacgtanagcaaggcaaacncgacgtcggactcgtacgtacttacgtttcggaccgacggggaaccaacgacggtaaggaaaacggaacggaaaaacgaccgtaaggtcgggtaaccgtacg

SEQ ID NO: 315640 - DNA, 662 bp, Homo sapiens
  misc_feature: GZ8MTXP02GSHSS.52.52.E08.1.454.CMB.2.raw
  modified_base (314)..(314): a, c, t, g, unknown or other
  misc_feature (314)..(314): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtgggatgttgtgatgactcagtctccactctccctgcccgtcacccttggacagccggcctccatctcctgcaggtctagtcaaagcctcgcacacagtgataggaaacacctactgaatttggttcagcagagccaggccaatcacaagcgtacttaatttagtaggtttcncgaccgggtactcgtcgggtccccagacagtacttcagcggcgaggtcgggtacagggtccacgttaggtactttaccgacgtactaagtaaaactcgaacgagtagggggtgaacgggattagggaaaagttgggttagggtttaagggggtttacttaacgtggtaccgtaagtcggaacgaaacgggcaaacgaacgtacgtcggtaacccgtcggtaccgttaaccgttacggttttccgggaaccggtaacgggggaaaccgtaacgggttaccggtaagggggaaaaccggaaaacgggtaaaacccggtaacggtttcgggttaaccgggcgttaacccgg

SEQ ID NO: 315641 - DNA, 627 bp, Homo sapiens
  misc_feature: GZ8MTXP02GR5SL.52.52.E08.1.454.CMB.2.raw
  modified_base (265)..(265): a, c, t, g, unknown or other
  misc_feature (265)..(265): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtgggatgttgtgatgactcagtctccactctccctgcccgtcacccttggacagccgcctccatctcctgcaggtctagtcaaagcctcgcacacagtgatagaaacactacttgaattggttnagcagagccaggccaatctaccgaaggcaccttaatttactaaggtttctcgaccgggtatcgtcggggtccccagacagattcagcgcgagtggtcgagcactagtatttactacgaccgttaaagtaaacgtacgaagacggaggggtagggaggtacgtagtaaggtaggtttagggtttagggtttacgttacgttacgtacgtagtagtacgaacggacgaacgaaccgtacgtacgtaccgtacggtaccgttaccgttacggtttacggtaccggtaaccggggtaaccggtaacggtacggtaagggtaaacggaaaacgggtaaaacggtaacggtacggtacggtacgtacg

SEQ ID NO: 315642 - DNA, 547 bp, Homo sapiens
  misc_feature: GZ8MTXP02HH66U.52.52.E08.1.454.CMB.2.raw
  modified_base (446)..(446): a, c, t, g, unknown or other
  misc_feature (446)..(446): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctactgaattggttcagcagaggccaggccaatctccaaggcgaccttaatttataaggtttctcgaccgggatcgtggggtcccccagacagattcagcgcaggtggggtcaggtcacgtgtacttcacgctagaaaatcaagcgagggtggaggcgtagaagtagttggtttaggggtttatttacgtggntagtgacgaaggcacacacgtgcctgtacgtactacgtttcggaccgacggggaccaacggcgtaaggaggaacggaaacgaacgtacggtggtacgtcgg

SEQ ID NO: 315643 - DNA, 638 bp, Homo sapiens
  misc_feature: GZ8MTXP02G4TLF.52.52.E08.1.454.CMB.2.raw
  modified_base (289)..(289): a, c, t, g, unknown or other
  misc_feature (289)..(289): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatctcctgcaggtctagtacaaagcctcgcacacagtgataggaaacacctactgtaatttggttcagcagagcagccaatcncaagctactaattatagttcacgacggactcgtcggtccccagacagacttcacggcgcgaggtcgggtacgaggcacgtagtactttccaacggtacctaaagaaaactacgaaggtacgagggggtacggaaggtcgtaggaaaggttaggttgggtttaagggtttatttaacgtggactagttcgacgaaacgggcaaacgaccgtaacgtcggaccgttacggtacgttaacgttaccgggttttacggaacccggtaacgggggaaacccctaaggtaccggtaaggggaaacgggaaaacggggtaaaaaccgtaccgtaggggtacggttacggtaaccgg

SEQ ID NO: 315644 - DNA, 614 bp, Homo sapiens
  misc_feature: GZ8MTXP02IB3VU.52.52.E08.1.454.CMB.2.raw
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctcatctcctgcaggtctagtcaaagcctcgcacacagtgataggaaacacctactgaattggttcagcagaggccaggccaatctaccgaaggcgtacttaatttataacggtttcacgaccgggtactcgtcggggtccccagacagatcgagcgcaggtcggtcaggcacgtgtacttccacgntaagaaatcaaggngtaaggggtggacggagttaggaagtagtttgggttttaggggtttatttagtgtacgagttcggacgaaaggcacgaacgtacgtcggccgtacggtaccgttacgttaaccgtttcggggaaccggtaaccggggtaaccgtaacggtaccggtaaggggaacggaaaacggggaaaacgtaaccggttgggttaccggtaacgtaccgg

SEQ ID NO: 315645 - DNA, 603 bp, Homo sapiens
  misc_feature: GZ8MTXP02FUS3U.52.52.E08.1.454.CMB.2.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtnatgaaacncctacttgaattggttcagcagagcagcaatcncagcnctatttanagttctcgacggatctgggtccccagacagatcagcgcagtgggtcaggcacgtgatttcacgctagaaaatcagcgaggggtgaggctagaagtagttgggttaggggttttatttacgtgggtactaagtacgacgaaacgggccaaacgaccgaaaccgtcgggcccgttaggacccgtttaaacgttaaccggtttttacggggaacccgttaacgggggtaaaacccctaagggtaccgtaaggggaaacggtaaaacggggaaaaaccgtaaaccggttagggtacgggtacgttaaccgg

SEQ ID NO: 315646 - DNA, 601 bp, Homo sapiens
  misc_feature: GZ8MTXP02IHU5K.52.52.E08.1.454.CMB.2.raw
  modified_base (421)..(421): a, c, t, g, unknown or other
  misc_feature (421)..(421): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgcacacagtgatacggaaacaccttacttgaatttggttacagcagacggccaggccaatctaccaaggcactaatttaataacggtttcacgaccgggactcgtcggggtacccccagaccagattcaggcggcgaggtggggtacagctagtgtacttcacgctagaaaactcagacgagggtggagngtagaagtagttaggtttagggtttaattacgtgacgtagtgacgaacggaccaacactacgtacggccctaggtaccgttacttaacggtttcggaacccggtacgggggaaccctaagggaccgttaagggaaggaaaacgggtaaaaccggaaacgtggttacggggaacttaccgg

SEQ ID NO: 315647 - DNA, 583 bp, Homo sapiens
  misc_feature: GZ8MTXP02JMX67.52.52.E08.1.454.CMB.2.raw
  modified_base (328)..(328): a, c, t, g, unknown or other
  misc_feature (328)..(328): n is a, c, g, or t
  modified_base (412)..(412): a, c, t, g, unknown or other
  misc_feature (412)..(412): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaatttggttacagcagacggccaggccaatctaccgaaggccgtaccttaaatttactaaacggtttcnccgaccggggtactcgtcggggtacccccagacagtattcagcgcaggtgggtcaggcactgtactttcgacgtctagaaactnaagcgaggggtggaggtctagaaggtagttaggtttaggggtttattacgtgtcgatggacaagggcaacgacgtacgtcgggcctacggacgttaccgtacggttttcgggacccgtacggggaaccaaggcgtaaggaacggaacggaaacgaacgtggtacgcgtacg

SEQ ID NO: 315648 - DNA, 658 bp, Homo sapiens
  misc_feature: GZ8MTXP02IFA94.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagagccaggccaatctcaaggcgaccttaatttataagtttctacgaccggtactccgtcggggtccccagacagtattcaggcggcgtaggtggggtaccaggggctactacgtatttccacggacttaggaaaattaccgaaggtacgaaggggtagggaggtacgttaggaaaggtagttagggtttttagggggtttaatttacggttagaccgtagttaggaccgtaaagggaccaaccgtaaacgaaccggttacggtaccgtcggtaccgttaaccgttaaacgtttttcggggaccggttaacgggggaacccgtaaggaccggttaacgggaagggtaaaacgggaaaaccggtaaacgtaagggttaccgggg

SEQ ID NO: 315649 - DNA, 659 bp, Homo sapiens
  misc_feature: GZ8MTXP02HLTJA.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtcctccactctccctgcccgtcaccttggacagcccggcctccatcctcctgcaggtctagtcaaagcctcgcacacagtgataggaaacacctactgtaatttggttacagcaggacggaccaggacctaatcctaccgaaggccgtaccttaaaatttaacgttaaacggtttcctacgaaccggggtacttcggtacggggtacccccccaagacagtacttacgacggcggcgaggttgggtacagggctaacgtgtacgttacgacgtacctaagtaaaactcgaagtacgtagggtaggacggtagtagaagtagttagggtttagggtttaattacgtgacgtagtacgacgaacggacaacgacgtacgtcggtaccgtacgtaccgttacgttacggtttaccgggaccggtaacggggaaccgtaacggacggtaacggggaaaggaaacggtaaaacggtaacggtaggtcgggttacgtaacgg

SEQ ID NO: 315650 - DNA, 570 bp, Homo sapiens
  misc_feature: GZ8MTXP02GXJSP.52.52.E08.1.454.CMB.2.raw
  modified_base (421)..(421): a, c, t, g, unknown or other
  misc_feature (421)..(421): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctactgaatttggttcagcagacgccaggccaatctacgaaggcgtaccttaaatttataacggtttctcgaccggtactcgtcgggtccccagacagattcgagcggcgtaggtgggtcaggcacgttgactttcacgtctaagaaatcagacgaggggtaggaggngtaggaagtagttggtttaggggtttattacgtgtactagtacgacgaaggacaacacacgtcgactcgacgttacgtacgtttacggaccgtaacggggaccaaggtacggaaggaaggaacggaaacgaacggtggtacggcgtacg

SEQ ID NO: 315651 - DNA, 554 bp, Homo sapiens
  misc_feature: GZ8MTXP02H2HF6.52.52.E08.1.454.CMB.2.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtccagcatccagtggggatgttgtgatgactcatctccactctccctgcccgtcacccttggacagccggctccatctctgcagtctagcaaagcctgcanacagtgatggaaacncctatggaatttggttcagcagcggccaggccaattcnccgaaaggctacctaaatttagtaaaggttttcncaccgggatcgttcggggcccccagcaanatacncgcgngngtggtcgagcagtatattacgacgataagtaaanacagagaggaggagagtagtagtagttggtttaggtttagttagtagtagagagagacgacgacacgacgtcgcgtacgtacgtacgttacgttacggtacggacggaacgaacgtacgtaacggaacggaaacggaaacgtaacgtacggtacggtacgtcg

SEQ ID NO: 315652 - DNA, 559 bp, Homo sapiens
  misc_feature: GZ8MTXP02JDTHC.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatcctcctgcaggtctagtacaaagcctcgcacacagtgataggaaacacctacttgaatttggttacagcagacggccaggaccaatctaccaaggccgtaccttaaatttagtaacggtttctaccgaccggtactcgtcggggtccccagaccagattcgagcggcgtaggtcgggtacaggctacgtgtacttcgacgtctaagaaatcgagcgagggtggagtcgtagaagtagttggttagggtttatagtgactagtgactaggcacacacgtcgctagcttacgtacgttcggacgtacggggaaccaggtcgaaggacgtaaaggaacgtacgtgtacggctacg

SEQ ID NO: 315653 - DNA, 636 bp, Homo sapiens
  misc_feature: GZ8MTXP02HCAZ4.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctcgcccgtcacccttggacacgccggcctccatctcctgcaggtctagtcaaagcctcgcacacagtgatacggaaacacctacttgtaattggttacagcaggacgccaggccaatcctaccgaaggccgtaccttaaatttagttaacggtttctaccgaccggtactccggtcggggtcccagacagacttcgagcggactaggtcgggtcgaggctacgtgtactttaccgacgtacgtaaagaaaagtcgaaggcggtaagggggtaggaggtacgtaaggtaaaggtagtttggggtttttaggggtttaacttacggttgacgtagtaggacgaaacgggcaacgtacgaccggttcggcccgttaggtaccgttacgttacggtttcgggacccgtaacgggggtaccaaggtcgaacggggaaggaacggaaaacgtacgtggacgg

SEQ ID NO: 315654 - DNA, 613 bp, Homo sapiens
  misc_feature: GZ8MTXP02FJ76M.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacacgccggcctcctatttcctgcaggtctagtacaaagcctcgcacacagtgatggaaacacctacttgaattggtttcagcaggacggccaggccaatctaccgaaggcgaccttaatttagtaaggtttcctcgaccggtactcgtcggggtaccacgacagtattcgaggtcggcgagggtgggtcaggcactgtactttcacgctagaaatcgagcgaggggtggaggcgtaggaagtagtttagggtttaggggtttaattacgtgtactagtagacgaaggacacacgtacgcggtccgtacggtaccgttacgttacgtttaccgggaccggtaacggggaaccgtaacggtaccgtaagggaaacggtaaacgggaaaacgtaaccggttggacggtacgtacggtaacccg

SEQ ID NO: 315655 - DNA, 622 bp, Homo sapiens
  misc_feature: GZ8MTXP02I78LF.52.52.E08.1.454.CMB.2.raw
  modified_base (392)..(392): a, c, t, g, unknown or other
  misc_feature (392)..(392): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccaggtggggatgttgtgatgactcagtctccactctccctgcccgtcacccttggacagccggcctccatctcctgcaggtctagtcaaagcctcgcacacagtgataggaaaccacctacttgaatttggttcagcagaggccaggccaatcctacaaggcgtaccttaatttataaggtttccacgaccgggtatcgtcgggtccccagacagattcgagcgcgagtgggtacaggcacgtgtattcacgtntagaaaatcgagacgaggggtggaggcgtagaagtaggttggtttagggggtttattagtagtacgagttacgacgaaacgggaccaaacgaccgtacgttcggggcccttagggtaccgttaaccgttacggttttacggggaccggtaacgggggaacccgtaaaggccggttaaggggaaacgggtaaacggggaaaacgtaacggtttacggtaggacgtaaccgg

SEQ ID NO: 315656 - DNA, 637 bp, Homo sapiens
  misc_feature: GZ8MTXP02IUFAX.52.52.E08.1.454.CMB.2.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatcctcctgcaggtctagtacaaagccctcgcacacagtgatacggaaacnctacttgatttggttnagcagagccagccaatcacagctctaatttatagttcncgaccggtctcgtcgggtccccagacagtattcgaggcggcgtagggtggggtacagggcctacgtggtactttcgacgtactaagaaaactcaagacgtagggggtaggaggtcgtagaagtagttggggtttaggggtttaagttaacgttgtacgagtagaccgaaggtccgaacaccgtaaccgtcggtcccgttcggtacccgtttaaccgttaccggtttttaccgggaccggtaacgggggaaaccccgtaagggttaccggtaaggggtaaacggaaacgggtaaaacggtaaaccggtcgggtacggtacgtaccgg

SEQ ID NO: 315657 - DNA, 611 bp, Homo sapiens
  misc_feature: GZ8MTXP02IC4VD.52.52.E08.1.454.CMB.2.raw
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatctcctgcaggtctagtcaaagcctcgcacacagtgatggaaacncctattgaattggttcagcagacgcaggccaatcnccaaggctacctaatttataaggtttctcgaccgggactcgtcggggtcccccagaccagtattcagcggcaggtgggtaccgagggcctaacgtgtactttcacgtacttagaaaactcgagacgaggggtggaggcgtagaagtagttagggtttaggggtttattacgtgcgtagtagacgaaggcgaacacgtacgtcggccgtcggtaccgtaccgttacggttttcgggacccggtaacgggggtaaccgaacggtccggtaaggggaaggaaaacggggtaaaaccggtaaacggtacggttacgggaccgttacgg

SEQ ID NO: 315658 - DNA, 778 bp, Homo sapiens
  misc_feature: GZ8MTXP02G7KOG.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccaggtggggatgttgtgatgactcagtctccactcctccctcgcccgtcacccttggacacgccgcctccatctcctgcaggtctagtacaaagcctcgcacacagtgatacggaaactaccgtacttagtaatttcggtttacacgacgaaggacggacccgaacgggaccctaaagttcccgtaaccgaaacggggtccgtaaccccttttaaaagtttttaaacggttaaacggtttttaccgtaccggtaaaccccggggtaccttcccggggttaccgggggttacccccaaggtaacctacggtaactttccggacggggccgggtaacggtaaggggttcggggttaccgaacggggtcctaaacgttcgttaactttaccgaacgtaccgtaaagtaaaacgttacgaacggacgggtagggggttagggacggtacgtaagggtaaaggttaggtttaggggtttttagggggtttaacttacggtagtacgtagttacgacgaacggtacaacgacgtacgtacgtcccgtagtaccgttaacgtacggtttacgggaccggtaacggggaaccgtaaggtacggtaagggaacggaaacggggtaaaacgtacggttaggtacgg

SEQ ID NO: 315659 - DNA, 642 bp, Homo sapiens
  misc_feature: GZ8MTXP02JWSA5.52.52.E08.1.454.CMB.2.raw
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgataggaaacacctacttgaatttggttacagcaggacggccaggaccaatcctaccgaaggccgtacctttaaaagtttaagttaaacgggttttcctaccgaaccggggtacctccggtcggggtacccccccaggacacggtaactttcgaaggtcgggcgtagggtcggggtaccagggcctacgtgtactttcgacgtctagaaaactcaagcgaaggggtggaggctaggaagtaggttgggtttaggggtttacttagtcgactagtcgacgaacggacaactacgacgtcggtccgtcggaccgttactacggtttaccggaccgtacggggaaccctaaggtccgtaaggggaacggaaacggaaaacgtaacgtcggtacgggactaccgg

SEQ ID NO: 315660 - DNA, 601 bp, Homo sapiens
  misc_feature: GZ8MTXP02G74V1.52.52.E08.1.454.CMB.2.raw
  modified_base (242)..(242): a, c, t, g, unknown or other
  misc_feature (242)..(242): n is a, c, g, or t
  modified_base (457)..(457): a, c, t, g, unknown or other
  misc_feature (457)..(457): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtnataggaaaccacctacttgaatttggttcagcagaggccaggccaatctaccaaggcgtaccttaaatttactaaggtttcacgtaccgggtactcgtcggggtcccccagactagacttcgagcggcgaggtcgggtcagggctaacgtggtactttacgacgtacgtaagtaaaactcgaaggacgtagggggtggaggtacgtagaaaggtnttaggggtttaggggtttaacttacgtggtacagtcgacgaaggcaacacgacgtcggcctacggtaccgtactacggtttacggcggaacggggtaacaaggtacgtgggaaacgaaggaaacgtacggtgtacggacgtccg

SEQ ID NO: 315661 - DNA, 616 bp, Homo sapiens
  misc_feature: GZ8MTXP02GF4B5.52.52.E08.1.454.CMB.2.raw
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (449)..(449): a, c, t, g, unknown or other
  misc_feature (449)..(449): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccgagtggggatgttgtgatgactcagtcctccactctccctgcccgtcacccttggacagccgcctcatcctcctgcaggtctagtacaaagcctcgacacacagtgatacggaaacncctattgaatttggttcagnagagccagactaanctaccgaaggctacttaatttataacggtttcacgaccgggtatcggtcggggtacccccagaccagtattacacggcgtcgagggttcggggacaacgggcctacgttagtactttacacgtactaagtaaaattcgagtacgaggggttaggaaggntaagaagttaggtttaggtttacggggtttaattaagtgtagtagtacgagaaggcaacgacacgtcggcctggtacgttacttacggtttacggaccggtacgggaacccgtaaggaccgtaagggaaaggaaacggtaaaccgaggtacggttaggtctaaccgg

SEQ ID NO: 315662 - DNA, 651 bp, Homo sapiens
  misc_feature: GZ8MTXP02GK6VI.52.52.E08.1.454.CMB.2.raw
  modified_base (253)..(253): a, c, t, g, unknown or other
  misc_feature (253)..(253): n is a, c, g, or t
tcagcgcagtacgacacgaccggtgctcgatttagtcgagctctcagagagaaaggggcaggactcctcagttcaccttctcacaatgaggctccctgctcagctcctggggctgctaatgctctgggtcccagcatccagtggggatgttgtgatgactcagtctccactctccctgcccgtcacccttggacagcccggcctccatctcctgcaggtctagtcaaagcctcgcacacagtgataggaaacncctattgaattggttacagcagaggccaggccaatctaccgaaaggccgtaccttaaatttacgtaacggttttcctaccgtaaccggggtacctccggtcggggtacccccccaagaccaggtacttaccgaggccgggtcgagggtcggggtaccacgggtccacgtaggtactttccgacgtactagtaaaactcgaaggtcgagggggttcggaagggacgtaggaagtagttagggtttaggggtttaactttacgtaggtacgtagtacgtacgaacggtacacgtacacgtcggccgtacggaccgttacgttacgtttcgggaccgtaacggggtaacccaggtacgtaagggaacgtaacgggaaacgtaacgtaggcggtacgtacgg

SEQ ID NO: 315663 - DNA, 748 bp, Homo sapiens
  misc_feature: GZ8MTXP02HSR8V.52.52.E08.1.454.CMB.2.raw
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactcctccctgcccgtcacccttggacacgccggcctccatctcctgcaggtctagtacaaacgcctcgcaacacagtgataggaaacacctattgaactttggtttcagcaggacggaccagaccaactccaccgaacgggcctaactttaaagttttaagtaaacggtttcctaccggaccggtactccggtacgggtacccccagacaagtacttacgagggtcggacgaggttaggggacgacgggactacgttagtactttaccgacgtacgttaaacgaaaacgttacgaacggtacggaaagggggttcgggaaccgggttacgtaaaggggtaaacggtaaggtttttcggggttttaaaggggttttaacgttaccggtagtaccgtaaggttacggacggtaaacgggaaccaacccgtaaccgtaacggttaccggtcccgttacggtaacccgtttaaccgttaccggttttaccgggacccggtaaaccggggtaaccgtaaacggccggtaaagggtaaacggaaaccgggtaaaacccggtaaacggtttcgggaaccggg

SEQ ID NO: 315664 - DNA, 759 bp, Homo sapiens
  misc_feature: GZ8MTXP02HLN5B.52.52.E08.1.454.CMB.2.raw
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
tcagcgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtgggatgtgtgatgactcagtctccactctccctgcccgtcaccttgacagccggctcatctcctgcaggtctagtcaaagcctgcacacagtgataggaaacacctacttgaattggttcagctagagcagcaatctacaaggcgacttaatttanaaggtttctacgaccgggactaccctcggggtaccccaggtaacgacgtacgttcgacgtccggagtaaacggtcggggtaacncgggtactacgtattacgttactaccgtaacggttaaacgtaaacgtacgacggtacgggtacgggtacgggtacggtacggtaagggttaaagggttaacgggttttaacggggtttttaagggggttttaaacgtttacggttaacgtaccgttaacggtaacggtaaacggtaaaccggtaaccgtaacccgtaaaccgtaccggtaccgggttacccggtttaccggtaacccgtttaaaccggttaaacccggttttaccggggtaacccggggtaaacggggtaaacccgggtaaacgggttaaccggtaaacggggtaaacgggtaaaaacgggtaaaaccggttaaaccggttaacgggttccgg

SEQ ID NO: 315665 - DNA, 487 bp, Homo sapiens
  misc_feature: GZ8MTXP01D36UU.38.7.A07.1.454.CMB.2.raw
  modified_base (332)..(332): a, c, t, g, unknown or other
  misc_feature (332)..(332): n is a, c, g, or t
  modified_base (421)..(421): a, c, t, g, unknown or other
  misc_feature (421)..(421): n is a, c, g, or t
tcagtcgatcacgtcacgaccggtgctcgatttagcacgtgtcgcaggggagagctctggggagtcagcaccatggcttggacccactcctcttcctcaccctcctcctccactgcacagggtctctctcccagcttgtgctgactcaatcgccctctgcctctgcctccctggagcctcggtcacgctcacctgcactctgagcagtgggcacagcagcaacgccatcgcatggcatcaacatcagccagagaagggccctggtacttgatgaagcttaaatagtgatggcaccctcaccaagggagacgggactccctgatcgcttctcnggctcagctcgtggggctgagcgctacctcaccatctccagcctccagtctgaggatggaggctgactatactgtcagtacggtgggcncgtgtccgtttgggtacttcgggcggagggaccgagctgaccgtcgtagggcacgccgaagggccg

SEQ ID NO: 315666 - DNA, 484 bp, Homo sapiens
  misc_feature: GZ8MTXP01B4ZZR.38.7.A07.1.454.CMB.2.raw
  modified_base (284)..(284): a, c, t, g, unknown or other
  misc_feature (284)..(284): n is a, c, g, or t
  modified_base (334)..(334): a, c, t, g, unknown or other
  misc_feature (334)..(334): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaanagtgatggcaccctcaccaagggagacgggactcccctgatcgcttctcnggctccagctctgggggctgagcgctacctcaccatcctccagcctccagtctgaggatgaggctgactntactgtcagcgtggggcncgtgccggtttgggtattcgggcggtgggaccgagctgaccgtctagggtcagcccaaggcc

SEQ ID NO: 315667 - DNA, 511 bp, Homo sapiens
  misc_feature: GZ8MTXP01EON8M.38.7.A07.1.454.CMB.2.raw
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaaagcttaatagtgatggcaccctcaaccgaagggagacgggatccctgactcgctctcaggctccngctcgtggggctgagcgctacctcacatctccagcctcagtctgacgatgaggctgactattactgtcagacgtggggctacgtgtccggtttgggtaattcgggcgggtagggaccgaaaggcgttcggccgttcgtaagggtcaacggcccgaaggcctcgcccccgtcggg

SEQ ID NO: 315668 - DNA, 504 bp, Homo sapiens
  misc_feature: GZ8MTXP01BUVRT.38.7.A07.1.454.CMB.2.raw
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaagggccctcggtacttgatgaagcttaatagtgatggcaccctcaccaagggagacgggatcccgtgactcggcttctcaggcctccngctcgtggggctgagcgctacctcaccatctccagccctcagtcngagatgaggctgactatactgtcagacgtggggctacgtgccggtttgggtaacttcgggcgggacgggaccaaggcttgcccgttcgtaagggtcaagcccgaggcctcgccccgttcgg

SEQ ID NO: 315669 - DNA, 266 bp, Homo sapiens
  misc_feature: GZ8MTXP01AZRYZ.38.7.A07.1.454.CMB.2.raw
  modified_base (263)..(266): a, c, t, g, unknown or other
  misc_feature (263)..(266): n is a, c, g, or t
tcagtcgatcacgtcacgaccggtgctcgatttagcacgtgtcgcaggggaagaccgatgggcccttggtggaggctggtacacccttgactactggggccagggaaacctactcaccgtctactcagcctccaccaagggcccatcggtcttccccctggcgccctgctccaggagcacctccgagagcacagcggccctgggctgcctggtcaaggactacttccacgtgatcgactgagcgggctggcaaggcgcatagnnnn

SEQ ID NO: 315670 - DNA, 484 bp, Homo sapiens
  misc_feature: GZ8MTXP01ANB86.38.7.A07.1.454.CMB.2.raw
  modified_base (334)..(334): a, c, t, g, unknown or other
  misc_feature (334)..(334): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaatagtgatggcaccctcaccgaagggagacgggactccctgatcgcttctcnggctccagctcgtggggctgagcgctacctcaccatctccagccctccagtctgaggagtgaggctgactattacngtcagtacgtgggcnctggtcgtttgggtattcgggcggagggaccagcgtgacgtcgtaggcagccgaaggcc

SEQ ID NO: 315671 - DNA, 498 bp, Homo sapiens
  misc_feature: GZ8MTXP01EQ9EM.38.7.A07.1.454.CMB.2.raw
  modified_base (331)..(331): a, c, t, g, unknown or other
  misc_feature (331)..(331): n is a, c, g, or t
tcagtcgatcacgtcacgaccggtgctcgatttagcacgtgtcgcagggctggggagtcagcaccatggcttggacccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaatagtgatggcacctcaccaagggagacgggatccctgactcgcttctcaggctccngctcgtggggctgagcgctacctcaccatctccagcctccagtctgagatgaggctgactattactgtcagacgtggggctacgtgtccgtttgggtaattcgggcgggagggttaccgaagcgttggaccgttctgggtcaacggcccagggcctcgccccgtcgg

SEQ ID NO: 315672 - DNA, 496 bp, Homo sapiens
  misc_feature: GZ8MTXP01DSMRU.38.7.A07.1.454.CMB.2.raw
  modified_base (296)..(296): a, c, t, g, unknown or other
  misc_feature (296)..(296): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaggccctggtacttgatgaagcttaatagtgatggcacctnaccgaagggagacgggactccctgatcgacttctcaaggctccagctcgtggggctgagcgctacctcaccatctcacgcctcacgtctgagagtgagtcgtcgactatactagtcgacgtacgtgggcgacgtcgtcggttgggtacgttcggtcggacggacgacgcgtcgcgtcgtacgtcgacgtccgaacgtccg

SEQ ID NO: 315673 - DNA, 527 bp, Homo sapiens
  misc_feature: GZ8MTXP01BMQWJ.38.7.A07.1.454.CMB.2.raw
tcagtcgatcacgtcacgaccggtgctcgatttagcacgtgtcgcagggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtactgatgaaagcttaatagtgatggccaccctcaaccgaagggagacgggatccccgtgactcgcttctcacggctccaagcctcgtggggctggacgcgctacctcaccatcctccagcctccagtcctgagatgaggctgactattactgtcagacgtggggctagtcgtccggttgggtaagttcgggcggtagggaccgaaaggtccgttacggacccgttccgtaagggtcaacggcccgaagggcctccgcccccgtcgg

SEQ ID NO: 315674 - DNA, 559 bp, Homo sapiens
  misc_feature: GZ8MTXP01DNUJ0.38.7.A07.1.454.CMB.2.raw
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatacaacatcagccaagaggaacgggcccctggtacttgatgaagcttaaagtagtgatcggaccaccctanaaccgaaaggggagaccgggtactccccgtgatccgtcttcctcgnggcctccgagtctcggtggggctggacgcgacctacctcaccactctaccacgtccctcgagtcgtagaggtagtggaggtctagtacttacttacgtgtacgaggtacggtggggctgtcggtcgggtttgggtacgttcgggacggagggacccgaggttcgtcggtacccggtcgtacggcgacgtcccgaacggtcccg

SEQ ID NO: 315675 - DNA, 514 bp, Homo sapiens
  misc_feature: GZ8MTXP01BKJ2A.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacggccctggtacttgatgaagcttaaatagtgaatggaccacccgtacaaccgaaaggggacgaacggggactccccgtagactccgcttctcaaggcctccagtctcgtggggctgagcgctacctcaccatcctccagccctcagtctgagagtgaggctgactatacgtgtacagtacgtgggctacgtgtaccggttgggtattcgggcggtagggaccgagcgtgaccgtcgtagtcgacgcccgaaggtccg

SEQ ID NO: 315676 - DNA, 265 bp, Homo sapiens
  misc_feature: GZ8MTXP01AGJ02.38.7.A07.1.454.CMB.2.raw
  modified_base (263)..(265): a, c, t, g, unknown or other
  misc_feature (263)..(265): n is a, c, g, or t
tcagtcgatcacgtcacgaccggtgctcgatttagcacgtgtcgcaggggaagaccgatgggcccttggtggaggctggtacacccttgactactggggccagggaaacctagtcaccgtctactcagcctccaccaagggcccatcggtcttccccctggcgccctgctccaggagcacctccgagagcacagcggccctgggctgcctggtcaaggactacttccacgtgatcgactgagcgggctggcaaggcgcatagnnn

SEQ ID NO: 315677 - DNA, 533 bp, Homo sapiens
  misc_feature: GZ8MTXP01BATY3.38.7.A07.1.454.CMB.2.raw
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatagaagcttaatagtgatggcaccctacaaccgaagggacgacgggactcccgtagatcgcttcncnggctccagctcgtggggctgacgcgctacctcaccatccnccacgcctcagtctagagngtgaggctagacttagtactgtacgagtacggtgggctacggtcggtccggtttgggtacgttcgggacgggtaacgggacccgaggttccgtaacgtaccggtccgtacggtcaacggtcccgaaggtcccg

SEQ ID NO: 315678 - DNA, 549 bp, Homo sapiens
  misc_feature: GZ8MTXP01EC6IS.38.7.A07.1.454.CMB.2.raw
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagtcttaatagtgatggcaccctanaaccgaaggggacgacgggactcccgtagactcgtcttactcaagggcctccgagcctcgtgggggctgacgcgctaccncaccatcctccacgccctcacgtctagacggagtggaggtctagactattacgtgtacgagtacggtcggggctacgtcggtccggtttggggtacgttcgggacgggtacgggaccgaaggttccgtcggacccgtccgtacggtccacggtcccgaacggtccccg

SEQ ID NO: 315679 - DNA, 542 bp, Homo sapiens
  misc_feature: GZ8MTXP01CMK7T.38.7.A07.1.454.CMB.2.raw
  modified_base (178)..(178): a, c, t, g, unknown or other
  misc_feature (178)..(178): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgccatcgcatggcatcaacatcagccaagaggaacggcccctacggtacttgatgaagtcttaaatagtgatcgggacaccctacaaccgaaagggacgacgggactcccgtgactcgcttctcaaggcctccgagtccgtcgcgggggctgacgcgcctacctcaccatcctccacgccctcagtctgagagtgaggtctagaactatactgtacgagtacggtggggctgtcggtccggttgggtagttccgggagggacggttaccgaggccgtaaggacccggtccgttaggccgacgcccgaacgggtcccg

SEQ ID NO: 315680 - DNA, 518 bp, Homo sapiens
  misc_feature: GZ8MTXP01D0ANY.38.7.A07.1.454.CMB.2.raw
  modified_base (423)..(423): a, c, t, g, unknown or other
  misc_feature (423)..(423): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaagcttaatagtgatggcacctcaccgaagggagacgggactccctgatcgcttactcaaggctccgagtctcgtggggctgacgcgctacctcaccatcctccacgccctccagtctagacggagtgaggctagactagttacgngtacgagtacggtggggctgtcgtcggtttgggtacgttcgggacggtagggaccgagcgtcggtaccgtcgtaggcgacgtcccgaaggtcccg

SEQ ID NO: 315681 - DNA, 591 bp, Homo sapiens
  misc_feature: GZ8MTXP01DQSIF.38.7.A07.1.454.CMB.2.raw
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaacggccctggtactgatgaaagtcttaanagtgaatggaccaccctagaaccgaaggggacgacgggactcccgtagacctccgtcttcgtcgacggcctaccgngcgtcgtggggctggacgcgctaccctcacctatcctaccacgccctacgagttcgagagtatgacggtctaggtaacttagttaccgtgtcgaggtacggttacggggctacggttcggttccggtttggggtaacgttcgggacggggaacggaccgaaaggtccgttacggttacccgttccgtaagggtccaaccggacccgaacgggttccgtccccgttccccgttccggg

SEQ ID NO: 315682 - DNA, 499 bp, Homo sapiens
  misc_feature: GZ8MTXP01CC9O9.38.7.A07.1.454.CMB.2.raw
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctccagcttgtgctgactcaatcgccctctgcctctcgcctccctgggagcctcggtcacgctcacctgcactctgagcagtggcacagcagcaacgcatcgcatggcatcaacatcagccaagagaacggccctggtacttgatagaagcttaaatagtgatggcacctcaacgaagggacgacgggactccngatcgcttacncgnggcctcagctcgtcggggctcggacgccgctaccncacctactcctccagcctcagtcngagtaggngngcgtagatatacgtcgtacgacgtacggtcggcgcgtcgtcggttggtcggttcggacggacggacgcgcgtcgcgtcgtcgacgacgcgcgcg

SEQ ID NO: 315683 - DNA, 514 bp, Homo sapiens
  misc_feature: GZ8MTXP01AM2HI.38.7.A07.1.454.CMB.2.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (446)..(446): a, c, t, g, unknown or other
  misc_feature (446)..(446): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaanagtgatggccaccctnaccgaagggagacgggatcccngactcgcttcncaggctccngctcgtggggctggagcgctacctcaccatctccagtccctccagtctgagatgaggctagactatactgtcagacgtgggctacgtgtccgggtttgggtaagttcgggngggagggacccgaagcttcggaccgttccgtaagggtccaacggcccaagggcctcggcccccgtcgg

SEQ ID NO: 315684 - DNA, 584 bp, Homo sapiens
  misc_feature: GZ8MTXP01D5JY2.38.7.A07.1.454.CMB.2.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacgggccctcggtacttgatgaagcttaagtagtgatggccaccctnaaccgaagggagacggatcccgngactcgtcttcgcacggtcctcngtctcgtggggctggacgcgctacctcaccactcctccgacgtccctaccgagtcgtagagggtatggacgtcgttagtacttattacgtgtacgacggacgggtcggggcctacggttcggttcccgggtttggggtaacgttcggggacggggtaacggacccgaaggtccgttacggttcccgttaccgttaacggaccgaacgtccccgacggttccctaacccggttccccgtccgg

SEQ ID NO: 315685 - DNA, 516 bp, Homo sapiens
  misc_feature: GZ8MTXP01CDDI8.38.7.A07.1.454.CMB.2.raw
  modified_base (277)..(277): a, c, t, g, unknown or other
  misc_feature (277)..(277): n is a, c, g, or t
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaanagtgatggcaccctcaaccgaagggagacgggatcccgtgactcggcttctcaggctccngctcgtggggctgagcgctacctcaccatctccagcctccagtctgagatgaggctgactatactgtcgagacgtggggctacgtggtccggtttgggtaacgttcgggcggacgggaccgtaaaggcgttacggccgttcgtaaggtcgaacgcccgaaggcctccgcccccgtccgg

SEQ ID NO: 315686 - DNA, 552 bp, Homo sapiens
  misc_feature: GZ8MTXP01AJGG8.38.7.A07.1.454.CMB.2.raw
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagtcttaatagtgatcggccaccctcaaccgaagggngacgggatcccgtgactcgcttcncaggctccgngctcgtggggctggacgcgtcctacctcacctatcctccacgccctccagtcgtaggaggatgaggctagtacttattacgtgtacgaggtacggtggggctacgtcggtccggtttgggtaacgttcggggacgggacgggaccgtaaggtcgttcggccgttccggtaacggtccgaacggcccgacgggttcctccggccccgttcgg

SEQ ID NO: 315687 - DNA, 549 bp, Homo sapiens
  misc_feature: GZ8MTXP01C12TU.38.7.A07.1.454.CMB.2.raw
  modified_base (345)..(345): a, c, t, g, unknown or other
  misc_feature (345)..(345): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaaagtcttaatagtgatggccaccctacgaaccgaaggggagacgggactcccgtgactcggcttctcgaggcctcngctcgtggggctgagcgctaccctcaccatcctccacgcctccagtctaggacgagtggacggtctacgtacttattacgtgtacgaggacggtcggggctacggtggtccggtttgggtaacgttcgggcgggtaacgggaccgaagggtcttacggcccgttcgtaaggtccgaacgcccgaaggcctcccggccccgtcgg

SEQ ID NO: 315688 - DNA, 620 bp, Homo sapiens
  misc_feature: GZ8MTXP01EEIP5.38.7.A07.1.454.CMB.2.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcaanagcagcaacgccatcgcatggcatcaantcagccagagaacggccctggtacttgatgaagtcttaaanagtgatcggcacctgaaccgaagggagacgggactccccgtagactccgtacttcgtacgaacgggtctcccgagtccgtcgggtcgggggcttggacgccgacctaacctccaccactcctaccaacgtcccctacgacgtccgtaggaggtacgttggaacggtcctagtaaccgttattaaccgtggttaccgaagggtaccgggtcggggtacctacgggttcgtccgggttttggggtaacgttccgggggacgggaacgggaccgaaggttccgtaacggtacccgttaaccgttacgggaccacgggaaccccgaacggggtccccg

SEQ ID NO: 315689 - DNA, 563 bp, Homo sapiens
  misc_feature: GZ8MTXP01DGFMU.38.7.A07.1.454.CMB.2.raw
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacggccctaggtacttgatagaaagtacttaatagtgaatcggaccaccccgtacgaaccgaaggggagacgggactcccgtgacctcgcttctcgacggcctccgngtctcggtggggctggacgcgtacctacctcaccactcctccacgccctacagtcgnggagatgacgtctagtaacttatacgtgtcgacggtcggtggggctacggttcggtccggtttgggtaacgttcgggcgggtacggaccgtaagcgttcgaccgttcgtaagggtacaacgtacccgaggttccgtccgccccgtcgg

SEQ ID NO: 315690 - DNA, 528 bp, Homo sapiens
  misc_feature: GZ8MTXP01BB26Z.38.7.A07.1.454.CMB.2.raw
  modified_base (339)..(339): a, c, t, g, unknown or other
  misc_feature (339)..(339): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaatagtgatggccaccctcaaccgaaggggagacgggactcccgtgactcgcttctcaggctccngctcgtggggctgacgcgctacctcaccatcctccagccctcagtctgagatgaggctgactattacgtgtcgagcggtgggctacgtggtccggtttgggtaacgttcgggcgggtacgggaccgaaggtccgttcggacccgttccgtaaggtccgaacgcccgaaggccgtccgttccccgtccgg

SEQ ID NO: 315691 - DNA, 580 bp, Homo sapiens
  misc_feature: GZ8MTXP01A2HMG.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacggccctggtactgatgaagcttaaatagtgatcggacacccgtcaaccgaagggacgacggggactcccgtagactcgcttctcgaaggcctccgagcctcgtggggctggacgcgctaccgtcaccatcctccacgcctccagtctgacggagtcggacggtctaggtactacgttacgtcgtacgacggtaccgggttggggctaacggtcggtcccgggttttgggtacggttccggggacgggtaacgggacccgaaggttccgtaacggtaacccggtccgtaacgggtccgaacggtccccgttaagggtccccg

SEQ ID NO: 315692 - DNA, 559 bp, Homo sapiens
  misc_feature: GZ8MTXP01AQA0X.38.7.A07.1.454.CMB.2.raw
  modified_base (349)..(349): a, c, t, g, unknown or other
  misc_feature (349)..(349): n is a, c, g, or t
  modified_base (401)..(401): a, c, t, g, unknown or other
  misc_feature (401)..(401): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaagtcttaaatagtgatggaccaccctacgaaccgaagggacgacgggactcccgtgactcgcttcgtcaggcctccngctcgtggggctggacgcgctacctcaccatcctccagccctcagtctgagntgaggctgacttattacgtgtcgaggacggtggggctacgttggtccggtttgggtaacgttcggggacgggtacgggaccgtaaaggtcgttacggacccggttccgttaagggccgaacggaccccgaacgggttccgtcccgcccccgtttccgg

SEQ ID NO: 315693 - DNA, 526 bp, Homo sapiens
  misc_feature: GZ8MTXP01A8RDK.38.7.A07.1.454.CMB.2.raw
  modified_base (408)..(408): a, c, t, g, unknown or other
  misc_feature (408)..(408): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaatagtgatggcacctcaccgaagggagacgggactccccgtgatcgcttctcaaggctccagctcgtgggggctgacgcgcctacctcaccatcctccacgcctcagtctgagagtgaggctgactntactgtcagtacggtgggcacgtggtccggtttggggtacgttcggggacgggaacgggaccgaaggccgtaacggtacccggtccgtaacgggtccacgggtcccgaagggtccccg

SEQ ID NO: 315694 - DNA, 577 bp, Homo sapiens
  misc_feature: GZ8MTXP01CZRST.38.7.A07.1.454.CMB.2.raw
  modified_base (344)..(344): a, c, t, g, unknown or other
  misc_feature (344)..(344): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcaggtggcacagcagcaacgccatcgcatggcatcaacatcagccaagagaacgggccctggtacttgatagaagtcttaatagtgatcggcaccctacaaccgaaagggagacgggactcccgagactcgcttacncgaaggctccgagcctcggtcggggctggacgcgacctacctcacctatcctccacgtccctacgacgtcgtaggaggagtacggaggtctaggtaacttacgttacgtcgtacgtaggtacgggtgggacctaggttcgggtccgggtttggggtacgttcggggacgggacgggaaccgaggttcgtaacggaccgttccgtaagggtccgacggtcccgaacgggtcccg

SEQ ID NO: 315695 - DNA, 512 bp, Homo sapiens
  misc_feature: GZ8MTXP01BECOH.38.7.A07.1.454.CMB.2.raw
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaagggccctggtacttgatgaagcttaatagtgatggcaccctcaccaagggagacgggatccctgactcgcttctcaggctccngctcgtggggctgagcgctacctcaccatctccagccctccagtcngagntgaggctgactattacgtgtcagacgtggggctacgtggtccggtttgggtaagttcgggcgggacgggaccgaaagggtcttcggccgttccgtaagggtcaacgccccgaggcctcgcccccgtcgg

SEQ ID NO: 315696 - DNA, 516 bp, Homo sapiens
  misc_feature: GZ8MTXP01CO58T.38.7.A07.1.454.CMB.2.raw
  modified_base (341)..(341): a, c, t, g, unknown or other
  misc_feature (341)..(341): n is a, c, g, or t
  modified_base (398)..(398): a, c, t, g, unknown or other
  misc_feature (398)..(398): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatagaagcttaaatagtgatggccaccctcaaccgaaaggggagacgggactccctgatcgcttctcnggctccgagctcgtggggctgagcgctacctcaccatctccagccctcagtctgagntgaggctagacttagtactgtacagtcggtggggcagtcggtccggtttgggtacgttcgggacgggacgttaaccgagttcgtgacccggtcgtaggtcacggtcccgaaggtcccg

SEQ ID NO: 315697 - DNA, 662 bp, Homo sapiens
  misc_feature: GZ8MTXP01DGVYL.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctacggtacttgatagaaagtcttaaatagtgatcggaccaaccctcgaaccgaaaggggacgaacgggactccccgtagaacctccggtactttcgtccgaagggtcccttaccgaaggtcctccgggtcggggggctacgggacggtccgtaccctaccctcaaccctactcctccacgccctaccgtagtccgtggaaggagtacggaacggtcgtacggtaactttaattaccgtagttaccgagggtaaccgggttcgggggacctacggttcgggttcccgggtttagggggtaacggttcgggggacgggaacgggaacccgaaaggtccgttacggacccgttccgttaagggaccaaccggaccccgaaggttcccgtcccgttcccccgttccgg

SEQ ID NO: 315698 - DNA, 547 bp, Homo sapiens
  misc_feature: GZ8MTXP01AI5SA.38.7.A07.1.454.CMB.2.raw
  modified_base (342)..(342): a, c, t, g, unknown or other
  misc_feature (342)..(342): n is a, c, g, or t
tcagtcgatcacgtcacgaccggtgctcgatttagcacgtgtcgcagggtctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaacgggccctggtacttgatgaagtcttaatagtgatcggcacccgtcaaccgaagggagacgggactccctgactcgcttctcgacggctccngctcgtggggctgacgcgctacctcaccatcctccacgtccctccgagtccgtaggacgtagtggacggtcgtagtacttattacgtgtcgagacggttgggctacgtggtccggtttgggtaacgttcgggacgggtacggaccgaaggtcgttcggacccgttccgtaaggtcaacgtcccgaggcctccggcccccgttcgg

SEQ ID NO: 315699 - DNA, 644 bp, Homo sapiens
  misc_feature: GZ8MTXP01DBBHF.38.7.A07.1.454.CMB.2.raw
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatcggcatcaacatacagccagacgaacgggccctaggtacttgatagaaagtcttaaataggtgagtcggaccaccccgtaccgaaccgaaagggggacggacgggtactccccgtagtacctccgtcttcgtccgacggtccctccgngtcgtcgggtcggggctaggacgcgtacctaccncacctatcctccacgcccctacgagtcgtaggacgtagtaggacggtctacggttaacttaattaccgtgttaccgaggttaccgggtcggggtacctacggttcggttcccggggtttggggtaacgtttcgggggacgggtaacgggttaccgaagggtccgttacggttacccggttccgtaaggggtccaacggtaccccgacgggccctaaccggcccccgttaacgg

SEQ ID NO: 315700 - DNA, 571 bp, Homo sapiens
  misc_feature: GZ8MTXP01D3HK5.38.7.A07.1.454.CMB.2.raw
  modified_base (355)..(355): a, c, t, g, unknown or other
  misc_feature (355)..(355): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtactgatagaaagtcttaatagtgaatcggaccaccctacgaaccgaaggggacgacgggactccctagactccgtcttcgtcacggcctccnggtctcgtggggctggacgcgctaccctcacctatcctccacgtcccttccagtccgtaggacggatagacgggcttagtaacttatttaccgtgtccgaggtaccggtggggacctacgttcgggtccggtttggggtaacttcggggacggacgggttacaaggtcgttcggaccgttcgtaaggtccgaacgtccgaggcctccgccccgtcg

SEQ ID NO: 315701 - DNA, 541 bp, Homo sapiens
  misc_feature: GZ8MTXP01DPVMD.38.7.A07.1.454.CMB.2.raw
  modified_base (361)..(361): a, c, t, g, unknown or other
  misc_feature (361)..(361): n is a, c, g, or t
  modified_base (428)..(428): a, c, t, g, unknown or other
  misc_feature (428)..(428): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggagccctcggtcacgctcacctgcactctgagcagtgggcacagcagcaacgccatcgcatggcatcaacatcagccagagaagggccctggtacttgatgaaagcttaaatagtgatggacacccctcgaaccgaagggggagacggggactcccgtagacctccggtactttctcgacggtccctccgngtcctcgtggggcctggacgccgctaccctcacctatcctccacgcctcagtcgtgagatgacggtntagacttatctgtcgagacggtgggctacgtgtccggttgggtaattcggggacggaggacgaaggtcttacggccgttcgtaaggcaacggcccaggcctccgccccgtcgg

SEQ ID NO: 315702 - DNA, 559 bp, Homo sapiens
  misc_feature: GZ8MTXP01A1I6H.38.7.A07.1.454.CMB.2.raw
  modified_base (283)..(283): a, c, t, g, unknown or other
  misc_feature (283)..(283): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaanagtgatggcaccctcaccgaagggagacgggactcccgtagactcgcttactcgaacggctccagtcctcggtgggggctgacgcgcctacctcaccatcctccagccctcagtctgacggtagtggaggtctagtactagttacgtgtacgaggtacgggtcggggctacggttggtccgggtttggggtacgttcgggggacgggtacgggacccgaggccgttaacggacccggttcgtacgggtaccgacggaacccgttaacgggtccccg

SEQ ID NO: 315703 - DNA, 598 bp, Homo sapiens
  misc_feature: GZ8MTXP01D4CD3.38.7.A07.1.454.CMB.2.raw
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagtcttaatgtgatggcaccctcaaccgaagggagacgggatccctgactcgtctcgtcaggcctccngctcgtggggctggacgcgtctaccgtcaccatcctcacgtccctccagtcngacgatggagtctagacttattacgtgtcgaggacgttggggcctacgttcggtcccggtttggggtaacgtttccgggggacggggtaacgggacccgaaacgggtcccgttacgggttaccccgttcccggtaaaggggttcccgaaccgggtaacccccggaaagggttccccgttaacccgggcccccccgttttaacccgggg

SEQ ID NO: 315704 - DNA, 527 bp, Homo sapiens
  misc_feature: GZ8MTXP01B58F2.38.7.A07.1.454.CMB.2.raw
  modified_base (333)..(333): a, c, t, g, unknown or other
  misc_feature (333)..(333): n is a, c, g, or t
  modified_base (386)..(386): a, c, t, g, unknown or other
  misc_feature (386)..(386): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaatagtgatggcaccctcaccgaagggagacggatccctgactcgcttctcaggctccngctcgtggggctgagcgcctacctcaccatcctccagccctccagtctgacgntgagggctgactattacgtgtcgaggcgtgggggctacgtcggtccggtttgggtaagttcggggcgggagggaccgaaggcgttacggcccggttccgtaacgggctaacggcccgaacgggcctccgcccccgttcggg

SEQ ID NO: 315705 - DNA, 531 bp, Homo sapiens
  misc_feature: GZ8MTXP01ERQVM.38.7.A07.1.454.CMB.2.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaacggccctcggtacttgatgaagcttaatagtgatcggacacccctcgaaccgaaaggggacgacgggactccccgtgactcgcttctcnggcctcgagctcgngggggctgagcgctacctcaccatcctccacgcctccacgtctagaggagtgaggtctacgacttatacgtgtacgagtacggtgggcacgtggtccggtttgggtacgttcgggcggacgggaccgagcgtcggaccgtaaccgtacggtcgacgtcccgaagggtcccg

SEQ ID NO: 315706 - DNA, 544 bp, Homo sapiens
  misc_feature: GZ8MTXP01CYHSF.38.7.A07.1.454.CMB.2.raw
  modified_base (178)..(178): a, c, t, g, unknown or other
  misc_feature (178)..(178): n is a, c, g, or t
  modified_base (341)..(341): a, c, t, g, unknown or other
  misc_feature (341)..(341): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgccatcgcatggcatcaacatcagccagagaacggccctggtactgatgaagcttaaagtagtgatggccaccctcaaccgaaggggacgacgggactcccgtgactcgcttctcncggctccgagctcggtggggctggacgcgcctaccctcaccatcctccagccctccagtctgaggagtggacggtctagaccttagttaccgtgtccaaggtcggtcggggctacggtcggtcgggtttgggtacgttcgggacgggagggttacccgaggccgtaaggtacccgtcgtacggtcacggtcccgaaggtcccg

SEQ ID NO: 315707 - DNA, 596 bp, Homo sapiens
  misc_feature: GZ8MTXP01ANXRJ.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccagagaacggccctggtacttgatgaagtcttaagtagtgatcggaccctacccgtacgaacccgaaggggacgacgggtactcccgtagacctccggtcttcgtcgacggtccctccgaagtccgtcggtgggggctggacgccgtacctaccctcaacctactcctccgacgtccctctagtcgtaggacgatggacggtctagtacttattacgtgtcgaggacggtcggggctacggtcggttccgggtttgggtaacgtcggggacgggtacgggaccgaaggtcgttacggttacccgttcgtaacgggtccgaacgcccgaggttcctcccggttccccgtcgg

SEQ ID NO: 315708 - DNA, 551 bp, Homo sapiens
  misc_feature: GZ8MTXP01DPFB7.38.7.A07.1.454.CMB.2.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
  modified_base (452)..(452): a, c, t, g, unknown or other
  misc_feature (452)..(452): n is a, c, g, or t
  modified_base (507)..(507): a, c, t, g, unknown or other
  misc_feature (507)..(507): n is a, c, g, or t
tcagtcgatcacgtcacgaccggtgctcgatttagcacgtgtcgcaggggagagctctggggagtcagcaccatgggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccaagagaaggccctggtactgatgaagcttaangtgatggacacccgtnaaccgaaggggngaccgggactccccgtagactccgcttacctcgnggcctcccgaaggcctcggtgggggctaggacgccgtcctacctcaacccatccctccacgccctaccgagtctagaggatggaggtctagactattacgtgtacnggtacggtggggcacgttgccgggttttgggacttcggggacgggtgggaaccgnggttcgtggacccgttcgaggtcacggtaacccgaagggtcccg

SEQ ID NO: 315709 - DNA, 601 bp, Homo sapiens
  misc_feature: GZ8MTXP01CA1WN.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaatagtgatggcaccctacaccgaagggagacgggatccctgactcggcttctcaggctccngctcgtggggctggacgcgctacctcaccactctccagccctccgagtccgtagacgatagagggtctagtacgttaattaccgtgtaccgacggtacggttacgggggcctaaccggtcggttccgggttttggggtaacgttccggggacggggtacgggacccgtaaagggtccttacgggttcccgttacccggtaacggggttcccgaaccggtccccggtaacgggttcccgtcccggccccccccggtttcccggg

SEQ ID NO: 315710 - DNA, 499 bp, Homo sapiens
  misc_feature: GZ8MTXP01EO0LZ.38.7.A07.1.454.CMB.2.raw
  modified_base (335)..(335): a, c, t, g, unknown or other
  misc_feature (335)..(335): n is a, c, g, or t
  modified_base (396)..(396): a, c, t, g, unknown or other
  misc_feature (396)..(396): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaaagcttaatagtgatggcacctcaccgaagggagacgggatccctgactcggcttctcaggctccngctcgtggggctgagcgctactcacatctccagcctcagtctgagatgagctgactatacngtcagacgtggggctacgtgtccgttgggtaagttcgggcgggaggaccgaaagtcgttgccgttcgtaagggtcaacgcccgaagggcctcgcccccgtcgg

SEQ ID NO: 315711 - DNA, 572 bp, Homo sapiens
  misc_feature: GZ8MTXP01DSNBU.38.7.A07.1.454.CMB.2.raw
  modified_base (283)..(283): a, c, t, g, unknown or other
  misc_feature (283)..(283): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacggccctggtactgatgaagcttaaanagtgatggaccaccctacaaccgaaaggggagaccggggtactccccgtagactcgcttcncnggcctccgagctcggtggggctgacgcgtactacctcaccatcctaccacgccctccgagtcgtgacggagttggacggtctaggtacttattacgtcgttaccgaggtacgggtcggggctacggtcggtcccgggtttaggggtacgttcggggacgggtacgggaccgaaggttcgtaacggtaccggtccgtacgggtaccgacggccccgaacggtccccg

SEQ ID NO: 315712 - DNA, 639 bp, Homo sapiens
  misc_feature: GZ8MTXP01C79EF.38.7.A07.1.454.CMB.2.raw
  modified_base (369)..(369): a, c, t, g, unknown or other
  misc_feature (369)..(369): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgccctcccgtgggacgcctcggtcacgctcacctgcactctgagcagtgggcacagcagcaacgccatcgcatggcatcaacatcagccaggagaacggccctggtacttgatagaaagtcttaaatagtagagtcggaccacccgtacgaaccggaagggacgacgggactcccgtagacctcgtcttcgtacgacggtccttaccgnggtccgttcggtcgggggctagggacgtccgtaccctaccctccacctactcctaccacgtccctccgagtccgtaggaggtagtaggaacggtcgttacggtaacttaagttaccgtagttacgacgggtacgggttcgggggcctacggttcggttccgggtttgggtaacggttcggggacgggtacggaaccgtaaggtccgttacggttacccgttcggtaaggccgaacggacccgacggccgtcccggttccccgttaaccgg

SEQ ID NO: 315713 - DNA, 508 bp, Homo sapiens
  misc_feature: GZ8MTXP01BHFZC.38.7.A07.1.454.CMB.2.raw
  modified_base (338)..(338): a, c, t, g, unknown or other
  misc_feature (338)..(338): n is a, c, g, or t
  modified_base (486)..(486): a, c, t, g, unknown or other
  misc_feature (486)..(486): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaaacgccatcgcatggcatcaacatcagccagagaacgggccctggtacttgatgaagcttaatagtgatggcaccctcaaccgaagggagacggatcccgtgactcgcttctcaggctccngctcgtggggctgacgcgctacctcaccatctccacgcctccagtctgaggatgaggctgactattacgtgtcagacggtgggctacgtgtccggtttgggaagttcgggcgggtacggaccgaagtcgacgccgttccgtaaggtcngcccaaggcctcgccccgtcgg

SEQ ID NO: 315714 - DNA, 555 bp, Homo sapiens
  misc_feature: GZ8MTXP01A3EJU.38.7.A07.1.454.CMB.2.raw
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgcatcgcatggcatcaacatcagccaagaggaacgggccctcggtacttgatgaaagcttaatagtnatggccacctcaaccgaagggagacgggatcccgtgactcgcttctcgacggcctccgngtcctcgtgggggtcctggacgcgacctaccctcaccactcctaccagtccctctagtccgtggaggagtaggacggcgtacggtaacttattacgtgtcgagtacggtggggctacgtcggtccgggttgggtaacgttcggggagggacgggacgaaggtcgttcgccgttcgtaaggcgaacgcccgtagccgtccgccccgtcgg

SEQ ID NO: 315715 - DNA, 703 bp, Homo sapiens
  misc_feature: GZ8MTXP01DZI3S.38.7.A07.1.454.CMB.2.raw
  modified_base (649)..(649): a, c, t, g, unknown or other
  misc_feature (649)..(649): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtggcaacagcagcaacgccatcgcatggcatacaacatcagccaagagaacggccctggtacttgatagaagtcttaaatagtgagtcggaccacccgtacgaaccgaaagggggacgaccggggtacctccccgtaggtactccggtcctttaccgacaacgggtccctaccgaacggtccgttccgggtcggggggtcttacgggacggcccggtacccttaaccccgtccgaaaccccttaacgttcccgtaccctaacggtccccttacccgaacgttccgtagggacggtaaggttacggggtaacggtccgttacggtaaacctttacgttaaccgttggtaaccgtaacggtaccgggttcgggggacctacgggttaacggttcccgggttttagggggtacgttccgggggacgggtacgggaaacccgnggttaccgtcggtaacccgtccgttagggccaacggtccccgaacgggttcccg

SEQ ID NO: 315716 - DNA, 679 bp, Homo sapiens
  misc_feature: GZ8MTXP01BD6XY.38.7.A07.1.454.CMB.2.raw
  modified_base (246)..(246): a, c, t, g, unknown or other
  misc_feature (246)..(246): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctccctgggagcctcggtcacgctcacctgcactctgagcaggtgggcacagcagcaacgccatcgcatggcatcaanatcagccagagaacgggccctggtacttgatgaagcttaatagtgagtggccaccctcgaaccgaaagggggacgacggggaacctccccgtaggtaactccggtcctttacctaccgaacgggtccttacccgaaggtccgttccgggtcggggggcccttagggacggtcccggtacccgttaaccccgttccaaaccccgtaacttccccgttaccccaacggtcccccttacccgtacgttccgttaagggaacggggtagttacgggaacggggtccttaggtaaaccttaacgtttaaccgtggttaccgaaggggtaccgggttcgggggcctaacggttcggtccgggtttggggtacgttcggggacgggtacgggaccgttagccgtggacccgtcgtacggtcgacgtcccgaacggtcccg

SEQ ID NO: 315717 - DNA, 734 bp, Homo sapiens
  misc_feature: GZ8MTXP01DXIKT.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgcatcgcatggcatcaacatcagccaagagaacgggcccctggtactgatgaagtcttaaagtagtgagtcgggaccacctcaaccgaaaggggacgacgggtactccccgtagactccgtacttcctcgaacgggccttcccgaaggtcccgtaccggttcggggggacctttgggaaccggtccggtacccttaaccccgtccctaacccctaacgttccccgttacccaaccggtcccctaccccgtaaaggttcccgttaagggaaccggggtaggttacgggaaggggtaccttacgggtaaacctttaacgtttaacgttcgtaaccggtaacggggtaaccgggttagggggtcccttaaacgggttccgggtttcccgggttttagggggttaacggtttccggggacgggggtaacgggaaccccgttaaagggttcccgttaacggtaacccggttccggttaacgggtccgaaccggtccccggaaacggtccccgg

SEQ ID NO: 315718 - DNA, 478 bp, Homo sapiens
  misc_feature: GZ8MTXP01EKLQQ.38.7.A07.1.454.CMB.2.raw
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaanagtgatggcacctnaccaagggagacggactccctgatcgcttcncngctcgagtctcgtgggctgacgcgctacncaccatcncacncncncgtctagagagtgngctgatatactgtacgagtgtggcgcgtcgtcggttggtgttcggcggacggacgacgcgtcgacgtcgtcgtcgacgtccgaacgtcg

SEQ ID NO: 315719 - DNA, 582 bp, Homo sapiens
  misc_feature: GZ8MTXP01CO3FA.38.7.A07.1.454.CMB.2.raw
  modified_base (345)..(345): a, c, t, g, unknown or other
  misc_feature (345)..(345): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagtcttaatagtgatggccaccctcgaaccgaagggagacgggactcccgtgactcgcttctcgacggcctccngctcgtggggctggacgcgctacctcaccactcctccacgcctccacgtcgtggacgagtggacggtcgtaggtacttagttaacgtcgtaccgaggtacggtcggggcgtacgttcggtccgggtttgggtaacggttccggggacgggtacgggttaccgaaacggtcgttacggaccggttccgtaacgggtccgaacggcccgtaacgggcccgtaaccggcccccgttccgg

SEQ ID NO: 315720 - DNA, 521 bp, Homo sapiens
  misc_feature: GZ8MTXP01BGX54.38.7.A07.1.454.CMB.2.raw
  modified_base (278)..(278): a, c, t, g, unknown or other
  misc_feature (278)..(278): n is a, c, g, or t
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtactgatgaagcttaanagtgatggccaccctcaaccgaagggagacgggatcccgtgactcgcttctcaggctccngctcgtggggctgagcgctacctcaccatctccagccctccagtctggagatgagctgactatactgtcagacgtggggctacgtgtccggtttgggtaattcgggcgggacggggaccgaaaggcgttacggcccgttccgtaagggtccaacggcccgaagggcctccggcccccgtcggg

SEQ ID NO: 315721 - DNA, 521 bp, Homo sapiens
  misc_feature: GZ8MTXP01EVM37.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaaagcttaatagtgatggcaccctcaaccgaagggagacgggatccctgactcgcttctcaggctccngctcgtggggctggagcgctacctcaccatctccagccctcagtctgagatgaggctgtactattactgtcagacgtggggctacgtgtccggtttgggtaattcgggcgggacgggttaccgaaaggtcgttcggccgttccgtaagggtcgaacggcccgaagggcctccgcccccgtcgg

SEQ ID NO: 315722 - DNA, 608 bp, Homo sapiens
  misc_feature: GZ8MTXP01BGEQO.38.7.A07.1.454.CMB.2.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaaagcttaagtagtgatcggaccaccccgtacaaccgaaggggagacgggactcccgtgactcgcttcncgaggcctccngctcgtgggggctggacgcgctaccctcaccatcctccgacgccctccagtccgtggacggtatggaggctaggtacttagttacgtgtacgaggtacgggtggggcctacggttcggtcccgggttttggggtaacgttccgggggacggggtaacggggttaccaacggggtccttaccgggacccggttcccgtaaggggtcccgaaccgggtaccccgaacggggttcccctcccgggttcccccccgttcggg

SEQ ID NO: 315723 - DNA, 593 bp, Homo sapiens
  misc_feature: GZ8MTXP01BV9G1.38.7.A07.1.454.CMB.2.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (389)..(389): a, c, t, g, unknown or other
  misc_feature (389)..(389): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaaacgccatcgcatggcatcaacatcagccagagaagggccctggacttgatgaaagcttaatagtgatggcaccctcacgaagggagacgggatccctgactcgacttctcaggctccngctcnggggctgagcgctacctcaccatctccaagtccctccagtcctgacgnttagacgggcttaggtaacttaacgttaactgtccgtaaggaccggttagggggctaacccgttggtcccgggtttttgggggaacgtttcgggccgggggtaaagggacccgtaaacggccgttagggaccccggttccgttaacggggttccgaacggacccccgtaaaggggccgttccccggttcccccgtttcccgggg

SEQ ID NO: 315724 - DNA, 548 bp, Homo sapiens
  misc_feature: GZ8MTXP01EAJ4H.38.7.A07.1.454.CMB.2.raw
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaaagcttaatagtgatcggaccaccctcaaccgaaggggacgacgggactcccgtagactcggcttcgtcaggcctcngctcgtcggggctcgacgcgctacctcaccatctaccagtccctcagtctgacgatgagctagacttattacgngtacaggtacggtgggctacgtggtccggtttgggaacgttcggggacgggacgggttacgaacggtcgttcgggaccgttacgtaacggtcgaacggtcccgaacgggcctcccgccccgttccgg

SEQ ID NO: 315725 - DNA, 649 bp, Homo sapiens
  misc_feature: GZ8MTXP01ALC5E.38.7.A07.1.454.CMB.2.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacntcagccagagacggcctggtactgatgaagcttaagngtgatggaccaccctacgaaccgaaggggacgaccgggactccccgtagtacgtccgtcttaccacgaacggtccctaccgagtccgtcgggtcgggggcttaggaccgtccgtacctacccgtacccaacctacgttcccacccgtacgtcccctacgtacgtcgtaggtaacggagtacgggtaacggtcgttacgtaaccttaagttacgttcgtaaccggaacggttccggggtcgggtacctcgggtttcgggttaacccggggttttgggtacgggttaccggggacggggtaacgggaaccgacggttccgtaacggtcccggtaaccggtacggccgaccgtaacccggaacggtccccg

SEQ ID NO: 315726 - DNA, 536 bp, Homo sapiens
  misc_feature: GZ8MTXP01B68ZC.38.7.A07.1.454.CMB.2.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacatcagccagaggaacggccctacggtactgatgaagcttaatagtgatggccaccctcaaccgaaagggagacgggactcccgtgactcgtcttactcaacggcctccgagctcgtgggggctggacgcgcctaccncaccntcctccacgcctccagtctgagacgtgacggctagactatacgtgtacgaggtacggtgggcacgtggtccggtttgggtacgttccgggacgggacgggaccgagttcgtaacggtacccgtccgtacggtccgacgcccgaaggtccccg

SEQ ID NO: 315727 - DNA, 557 bp, Homo sapiens
  misc_feature: GZ8MTXP01C3QW0.38.7.A07.1.454.CMB.2.raw
  modified_base (178)..(178): a, c, t, g, unknown or other
  misc_feature (178)..(178): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtggcacagcagcaacgccatcgcatggcatcaacatcagccagaggaacggccctggtactgatgaaagcttaatagtgatggccaccctnaaccgaaggggagacgggactcccgtgactcgcttctcgcggctcccgagctcggnggggctgacgcgcctacctcaccatccgtccacgccctcgagtctagacgtagtgggaggtctaggtaccttagttacgtgttacgaggtacggtggggctacggtggtccgggtttggtacgttcgggacgggacgggttaaccgaggttcctaacgggtacccgtcgtacggtcgacggtaacccgaacgggtccccg

SEQ ID NO: 315728 - DNA, 529 bp, Homo sapiens
  misc_feature: GZ8MTXP01AR14Z.38.7.A07.1.454.CMB.2.raw
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaatagtgatggacacctcaaccgaaggagacggactccctgatcgacttcncnggctcgagctcgtggggctgacgcgctacctcaccatctccagtccctcacgtctagaggagtgaggctagacttagttacgtgtacgagtacggtgggctacgtcggtaccggtttggggtacgttcggggcgggaacgggttaccgaaggttccgtaaggcccggtcgttacggcacggcccgaacggtccccg

SEQ ID NO: 315729 - DNA, 566 bp, Homo sapiens
  misc_feature: GZ8MTXP01CDZZ1.38.7.A07.1.454.CMB.2.raw
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaacggccctggtacttgatgaaagtcttaatagtgatcggccaccctacgaaccgaaggggagacgggactcccgtagacctcggtcttcgtcgacggcctccgngctcggtgggggctggacgcgcctaccctcaccactccnccacgccctccgtagtcctaggacgagtcgaggtctagtacttattacgtgtcgaggtacggtgggctacgtggtccggtttgggtaacgtcgggacgggtacgggacgtaaggtcgttacggaccgttcgtaaggtccgaacgacccgtaggccgtcccggttccccgtccgg

SEQ ID NO: 315730 - DNA, 508 bp, Homo sapiens
  misc_feature: GZ8MTXP01DASF1.38.7.A07.1.454.CMB.2.raw
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (388)..(388): a, c, t, g, unknown or other
  misc_feature (388)..(388): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacggcctggtactgatgaagcttaaatagtgatggcaccctcaaccgaagggagacgggactcccgtgatcgcttcncnggctccagctcgtggggctgagcgctactcacatctcagcctcagtctagacgntgaggctgactattactgtacagtacgtggggcacgtcggtcggtttgggtacgttcgggacgggacgggaccgaggttccgtggaccgtccgttaaggcgacgcccgaacggggtcccg

SEQ ID NO: 315731 - DNA, 583 bp, Homo sapiens
  misc_feature: GZ8MTXP01ELALT.38.7.A07.1.454.CMB.2.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaacgggccctggtacttgatagaagcttaaatagtgatggccaccctcaaccgaagggagacgggatccctgacctcgcttctcaggcctcngctcgnggggctgacgcgctaccctcacctatcctccacgtccctccgagtctaggagntagacggctgtaacttattacgtgtaccgaggtaccggtggggcctacgttcgggttccggtttggggtaacgttccggggacgggtaacggggaacccaaagggtccgttacgggttacccgttaccgtaagggttccaacgggtccccgaagggttcccgttcccggttcccccgttccggg

SEQ ID NO: 315732 - DNA, 559 bp, Homo sapiens
  misc_feature: GZ8MTXP01ATOU1.38.7.A07.1.454.CMB.2.raw
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatacaacatcagccagagaacggcctcggtactgatagaagtcttaaagtagtgagtcggaccaccgtacgaaccgaaggggacgacgggactccgngactccgcttacncgcggctccgagcgtcgtggggctcgacgcgtactacctcacctactcctccacgtcctccgagtcgaggagaggtcggaggtctagtaacttagttacgtgtaccgtaggtacgggtacggggctacggtcggtccgggtttgggtacgttcgggacgggacggaaccgaggttcgtcggaccgtcgtacggtcgacgccgaacggtcccg

SEQ ID NO: 315733 - DNA, 606 bp, Homo sapiens
  misc_feature: GZ8MTXP01A71QF.38.7.A07.1.454.CMB.2.raw
  modified_base (185)..(185): a, c, t, g, unknown or other
  misc_feature (185)..(185): n is a, c, g, or t
  modified_base (371)..(371): a, c, t, g, unknown or other
  misc_feature (371)..(371): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagtcgatcacgtcacgaccggtgctcgatttagcacgtgtcgcaggggagagctctgggggagtcagcaccatggcttggaccccactcctcttcctcaccctcctcctccactgcacagggtctctctcccagcttgtgctgactcaatccgccctctgcctctcgccctcccgtggggacncctcggtcacgctcacctgcactctgagcaggtgggcacagcagcaacgccatcgcagtggcatcaacatcagccaaggaggaacgggcccctaggtactgatagaagtacttaaagtagtagattcggacctacccgtacgaaaccggaaggggacgacggtacctcccgtagactcgtcttacncgaaggtcctcgagtcctggtggggctaggacgtcgtacctaccnccaccactcctaccgacgtccctaccagttcaggaaggngtaggacggtctacgtaacttagtaccgtggtaccgaggtacggtcgggtactcggttcggttccgggtttgggtacggttcggggacgggtaacggttaccgaggttccgtaacggtaccgtcggtacgcgaccgtccgaacggtccccg

SEQ ID NO: 315734 - DNA, 537 bp, Homo sapiens
  misc_feature: GZ8MTXP01B94KZ.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccaagagaacggccctggtacttgatgaagcttaatagtgatggcacctcgaaccgaagggacgacgggactcccgtagactcgcttctcgcggctccgagctcgtggggctgagcgctactcaccatcctccagccctcagtctgacggtagtggacggtctagtacttagttactgtacgaggtacggtcggggctacggtcggtccggtttggggtacgttcggggacgggacgggttaccgaggttcgtaaggacccgtcgtacggtcgacgcccgaaggtcccg

SEQ ID NO: 315735 - DNA, 567 bp, Homo sapiens
  misc_feature: GZ8MTXP01BQ3Y3.38.7.A07.1.454.CMB.2.raw
  modified_base (351)..(351): a, c, t, g, unknown or other
  misc_feature (351)..(351): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaaagtcttaaatagtgatggaccaccctacgaaccgaagggagacgggactcccgtgactcgtcttcgtcgacggcctcgngcgtcgtggggctgacgcgctacctcaccatcctccacgtcctccagtcgtgacggagtagacgtcgtagtacttacgttacgtgtcgaggtacggtcggggcgtacgtggtccggtttgggtaacgttcgggacggggtacggttaccgaagtcgttacggccgttaccgtaagggtccgaacgacccgacggttccgtccgttccccgttccgg

SEQ ID NO: 315736 - DNA, 644 bp, Homo sapiens
  misc_feature: GZ8MTXP01DL1U8.38.7.A07.1.454.CMB.2.raw
  modified_base (302)..(302): a, c, t, g, unknown or other
  misc_feature (302)..(302): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcagtggcatcaacatcagccaagagaacggccctggtacttgatgaagcttaaatagtgatggaccacctnaaccgaagggacgacgggactcccgtagactcgtcttactcgaacggcctccgacgtctcggtcgggggctgggacgccgtacctaccctcaacctactccctaccacgtccctaccgacgttcgtaggaggtagttaggaacggtcttacggtaacctttaacgtttaacgtcgtacggaacggtaaccgggttcgggggacctaacggttcggttccggggttttaggggtacggtttccggggacggggtaacgggaaccgttaacgggttaccgttaacgggaaccccggttccggttaacgggtcccgaccgggtaacccgaaacggggttcccccg

SEQ ID NO: 315737 - DNA, 502 bp, Homo sapiens
  misc_feature: GZ8MTXP01C5Z4I.38.7.A07.1.454.CMB.2.raw
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
  modified_base (476)..(476): a, c, t, g, unknown or other
  misc_feature (476)..(476): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcacaaggggagacgggatccctgactcgctctcaggctccngctcgtggggctgagcgctacctcacatctccagcctccagtcngagatgagcgtgacttattactgtcaggacgtggggctacgtggtccggtttgggtaagttcgggcggacggaccgagcttcgccgttccgtaaggcncggcccgaggccgtccgcccccgtcg

SEQ ID NO: 315738 - DNA, 676 bp, Homo sapiens
  misc_feature: GZ8MTXP01B950C.38.7.A07.1.454.CMB.2.raw
  modified_base (348)..(348): a, c, t, g, unknown or other
  misc_feature (348)..(348): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagtcttaatagtgagtggccacccgtacaacgaaggggacgacgggactcccgtgacctcgcttctcgacggcctccngctcgtgggctgacgcgctaccctcaccatcctccgacgtcccctaccgagttccgtaggacggtaagtcgggtacgggtccttaaggttaacctttaacgtttaccgtacggtccgtaaacgggtacggggttacggggggaccttaccggtttcggggttccccggggtttttagggggtaacgtttccgggggaaccggggtaacggggaaccccgtaaacgggtcccgttaccgggttaccccggtttaccgggtaacgggtcccgaaccgggttcccccgaacgggggttccccttccccgggttcccccccggtttcccggg

SEQ ID NO: 315739 - DNA, 613 bp, Homo sapiens
  misc_feature: GZ8MTXP01D7JO2.38.7.A07.1.454.CMB.2.raw
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgcatcgcatggcatacaaacatcagccaagacggaacggccctaggtacttgatagaaagtcttaaagtgtgaatcggccaaccctacgaaccgaaagggacgacggactccctgacctcggnttcgacgacggctccgaagtccttcggngggggcctaggacggcctaccctaccctcaaccctatccctccaacgtccccttaccgaggttcgaggaaggaactggaacggtctacggtaacttacttacgtcgtacgacggtacgggttcggggactacggttcggtccggtttgggggtaacttcgggggacgggaacggacccgaaggtcgttacggacccgttcgtaacgggcaaccggccgaacggcctcccgttccccgtcgg

SEQ ID NO: 315740 - DNA, 556 bp, Homo sapiens
  misc_feature: GZ8MTXP01C6VIY.38.7.A07.1.454.CMB.2.raw
  modified_base (246)..(246): a, c, t, g, unknown or other
  misc_feature (246)..(246): n is a, c, g, or t
  modified_base (382)..(382): a, c, t, g, unknown or other
  misc_feature (382)..(382): n is a, c, g, or t
tcagtcgatcacgtcacgaccggtgctcgatttagcacgtgtcgcaggggagagctctggggagtcagcaccatggcttggaccccactcctcttcctcaccctccccctccactgcacagggtctctctcccagcttgtgctgactcaatcgccctctgcctctgcctccctgggagcctcggtcacgctcacctgcactctgagcagtgggcacagcagcaacgccatcgcatggcatcaacancagccagagaacgggccctggtacttgatgaagtcttaaatagtgatggaccacccgtcaaccgaagggacgacgggactcccccgtgactcgcttcacagctcagctcgtgggctgacgcgctacctcaccatcnccacgcctcagtctggagactgggacggctagaacttagttacgtgtcgaacggtacggtggggctacgtggtcccgggtttgggttacggttcgggacgggtacgggacccgaaggcgttacggaacccggtaccgtaagggtccgacggacccgtaacggccgttccccggg

SEQ ID NO: 315741 - DNA, 635 bp, Homo sapiens
  misc_feature: GZ8MTXP01DQYAN.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaaacgccatcgcatggcatcaacatcagccaagagaacgggccctggtacttgatagaaagtcttaaatagtgaatggaccaccctcgaaaccgaaaggggagaaccgggatccccgtagaccgtccgtacttctcgaacgggtccctccgaagtccgtcggtgggggcctggacgccgacctaaccctcaccaacttccctcccacgtccctacgtacgtcgaggaggtagtagaggtacgtacgtaacttacttacgtcggtacgacggtacgggtacgggaccgtacggttcgggttaccgggtttgggtaacggttcggggacgggtaacggaaccgtaaacggtccgttaccggttacccgttacggtaacggtaccgaaccggacccgtacggcccgtcccggttccccgtcg

SEQ ID NO: 315742 - DNA, 534 bp, Homo sapiens
  misc_feature: GZ8MTXP01DW1WL.38.7.A07.1.454.CMB.2.raw
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggcacagcagcaacgccatcgcatggcatcaacatcagccaagagaacggccctggtacttgatagaagtcttaaanagtgatggaccaccctacgaaccgaaagggacgacgggactcccgtgactcgcttcncnggctccgagctcgggngggcngacgcgactacncacactcncacgccncacgtcgtagagaggtgagcgtacgtactatacgtagtacgacggtacggtcggtcgtcgtcggtcggttgggtacggttcgggtacgggacggacgacgttacgtcgtacgtcgtacgtacgacgtaaccgaacgtcg

SEQ ID NO: 315743 - DNA, 662 bp, Homo sapiens
  misc_feature: GZ8MTXP01B4EDT.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgccatcgcatggcatcaaacatcagaccaaggacgaacgggccctaggtacttggaatgaaagtcttaaagtagtgatacggaccacccgtacgaacgaaggggacgaacgggactcccgtagacctccggtcttcgtcgacggccctaccgcggtccgtcggtcggggctacgggacgtccgtaccctaccctccaacctactccctacccgacgtccccttacgacgtccgtaggaggtacgtagggtacggtcttaacggttaacttacgttaaccgtgtaccgaacggtacgggtcgggggacctacggttcggttcccgggtttagggtaacggttccggggacgggtaacggaaccgtaacggtcgttacggttcccgttaccgtaaggtccgaaccggtcccgaacggttccgtaacccggttccccgtaaccgg

SEQ ID NO: 315744 - DNA, 485 bp, Homo sapiens
  misc_feature: GZ8MTXP01DTE3I.38.7.A07.1.454.CMB.2.raw
  modified_base (297)..(297): a, c, t, g, unknown or other
  misc_feature (297)..(297): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctccagcttgtgctgactcaatcgccctctgcctctgcctccctgggacgcctcggtcacgctcacctgcactctgagcagtggcacagcagcaacgccatcgcatggcatcaacatcagccagagaaggccctggtactgatgaagcttaaatagtgatggcaccctnaaccgaagggagacgggactccctagatcgctctcaaggctccagctcgtggggctgagtcgctacctcaccatcctcagcctcagtctagaggagtgaggctgactattactgtacagtacggtggcagtgtcgttgggtattcgggacggagggacagctgaccgtctaggcagtccgaagtcccg

SEQ ID NO: 315745 - DNA, 522 bp, Homo sapiens
  misc_feature: GZ8MTXP01CWGT3.38.7.A07.1.454.CMB.2.raw
  modified_base (334)..(334): a, c, t, g, unknown or other
  misc_feature (334)..(334): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctcggtacttgatgaagcttaatagtgatggcaccctcaccgaagggagacgggatcctgactcgctctcaggctccngctcgtggggctgacgcgctacctcaccatctcagcctccagtctgacgatgagctgacttatactgtcagacgtgggctagtgtccggtttgggaacgttcgggacgggtacgggaccgtaaaggccttaggacccgttccgtaagggtccaacgggccccaaggggcctccggcccccgttccggg

SEQ ID NO: 315746 - DNA, 507 bp, Homo sapiens
  misc_feature: GZ8MTXP01AXSED.38.7.A07.1.454.CMB.2.raw
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (477)..(477): a, c, t, g, unknown or other
  misc_feature (477)..(477): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaanatcagccagagaaggcccctggtacttgatgaagtcttaaatagtgaatgggaccaccctacaaccgaaggggacgacggggactcccgtagactcgacttctcaaggctccagctcgnggggctgagcgctaccncacntcncacnccncngtgagagngngagntagtactntcgtgtacgaggtcggtggcgtcgtcgggtcggttggtacgttcgggacggacggacgngcgtcgcgtcgtaggcgacgtccgcggccg

SEQ ID NO: 315747 - DNA, 540 bp, Homo sapiens
  misc_feature: GZ8MTXP01BVJTX.38.7.A07.1.454.CMB.2.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttggatgaaagtcttaaatgtgatggaccacccctacgaaccgaaggggacgacgggactcccgtgactcgcttcgcaggctccngctgnggggctgacgcgctacctcaccatctccagccctcgagtcgagagntgaggctagtacttattactgtcgagtacggtgggctacgtggtccggtttgggaacgttcggggcgggtaacggaccgaaggtcgttacggcccgttccgtaaggtccaacgccccgaaggcctccgttccccgttcgg

SEQ ID NO: 315748 - DNA, 675 bp, Homo sapiens
  misc_feature: GZ8MTXP01CZQ73.38.7.A07.1.454.CMB.2.raw
  modified_base (280)..(280): a, c, t, g, unknown or other
  misc_feature (280)..(280): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctccacctgcactctgagcagtgggcacagcagcaacgcatcgcatggcatacaacatcagccagagaacggccctggtactgatagaaagcttaanagtagatcggaccaccctacgaaccgaagggacgaacgggactccctagactcgcttcgacgacggcctaccgngtccgtcggtacggggctacggacgccgacctaccctcacctactcctaccacgtccctaccgtagttcgaggaacgtagttacggacggtacttacggtaaaccttaacgtttacgtagtacggtaacggtacgggttacgggggtacctaaccggttcgggttaccgggttttagggggtaaacggtttccgggggaccggggtaacgggaacccgttaaacgggcccgttaacgggttaccccggttacgttaacggggtaccgtaaccgaccccgggtaacggttcccgttccccggttccccccggtttaaccggg

SEQ ID NO: 315749 - DNA, 570 bp, Homo sapiens
  misc_feature: GZ8MTXP01B7YRJ.38.7.A07.1.454.CMB.2.raw
  modified_base (179)..(179): a, c, t, g, unknown or other
  misc_feature (179)..(179): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacncctcggtcacgctcacctgcactctgagcagtgggcacagcagcaacgccatcgcatggcatcaacatcagccagagacggccctcggtactgatgaagtcttaatagtgagtgggaccaccctacaccgaagggacgacgggactcccgngactcgcttctcnggcctcgagctcggnggggctggacgcgcctacctcaccatcctaccgacgcccttacgacgtctaggacggaggtggaacgggtctaggtaactacgttaaccgtgtacgacggtacgggtcgggcacgttcggtccgggtttagggtacggttcggggacgggaacgggaccgttaggccgtcggtaacccgtccgtacgggtacaccggcccgaacggtccccg

SEQ ID NO: 315750 - DNA, 538 bp, Homo sapiens
  misc_feature: GZ8MTXP01CBGYT.38.7.A07.1.454.CMB.2.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaanagtgatggcacccgtacaccgaagggagacgggactcccgtgactcgcttctcgaggcctcgngctcgtggggctgacgcnctactcacntctcacgcctcagtcngagatggaggtctgtaacttagttacgtgtcgagtacggtggggacctacggttcggtccgggtttggggtaacgttcggggacgggtacgggacccgtaaggccgttacggaccgttccgtaaggccaacgcccgacggcctccgccccgtcgg

SEQ ID NO: 315751 - DNA, 592 bp, Homo sapiens
  misc_feature: GZ8MTXP01EK2NI.38.7.A07.1.454.CMB.2.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtggcacagcagcaacgccatcgcatggcatcaacatcagccaagaggaacggccctggtactgatgaaagtcttaatgtgatggaccaccgtacgaacgaagggacgacggtactcccgtgactcgtcttcgcaggccctacgnggccgtcggnggggctaggacgcgtcctaccctccacctactcctacccacgtcccctacgtagtccgtaggaacgtagttagggaacgtcggtataacgttattaacgtcgtagacgggtacgggtagggtcctacggtttcggtaccgggtttggggtaacgttcgggacgggtaacgacgagtcgttacgttccgttacgtgtaccgaacgtcccggagttcctcccgttcccgtaacg

SEQ ID NO: 315752 - DNA, 585 bp, Homo sapiens
  misc_feature: GZ8MTXP01C838C.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgcatcgcatggcatcaacatcagccagagaacggccctggtactgatgaagcttaaatagtgatcggaccaccctcaaccgaaggggacgacggggactccccgtagacgtcgcttactcgcggcctccgagtccgtcgtgggggctggacgcgcctacctcaccactcctccacgccctcagtctaggacggagtggagggtctaggtacttaagttaccgtgtaccgaggtacggtgggggcctacggtcggtccgggtttggggtacggttcggggacggggtagggaaccgaacgggttccgtaacgggtacccggtccgtacgggtacgaccggtaaccccgaacgggtccccg

SEQ ID NO: 315753 - DNA, 643 bp, Homo sapiens
  misc_feature: GZ8MTXP01C0OXN.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggcccctggtactgatgaagtcttaagtagtgatcgggaccacccgtacgaaccgaaaggggacgaccggggacctccccgtaggacttccggcctttaccgcgaacgggtccctacccgacggtccgtcgggtcgggggaccttagggaccgtccggtacccttaccccttaccaaccctaacttccctaccccgaacggtccccctaccgtaacggttcccgtagggaacgggtaggttacgggaacggggtaccttacggtaacttacttacgtgtaccgacggtacgggtaggggcctacggttcggtccgggtttgggtacgttcggggacgggtagggaccgaggcgtcggaccgtcgtggtcacgccgaacggtcccg

SEQ ID NO: 315754 - DNA, 549 bp, Homo sapiens
  misc_feature: GZ8MTXP01BFIZC.38.7.A07.1.454.CMB.2.raw
  modified_base (345)..(345): a, c, t, g, unknown or other
  misc_feature (345)..(345): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaggagaacgggccctggtacttgatgaaagcttaaatagtgatggccacccgtcaaccgaaggggagacgggatcccgtgactcgcttcgcaggcctcgngctcgtggggctggacgcgacctaccctcaccactctcccagccctccagtctgagntgaggctgactattacgngtcgagaccggtgggctacgtggtccggtttgggtaacgttcgggcgggaacgggttaccgaaaggtcgttacggttaccggttccgttaagggcaacggaccccgaggccgtcccggcccccgttcgg

SEQ ID NO: 315755 - DNA, 606 bp, Homo sapiens
  misc_feature: GZ8MTXP01D3HTG.38.7.A07.1.454.CMB.2.raw
  modified_base (357)..(357): a, c, t, g, unknown or other
  misc_feature (357)..(357): n is a, c, g, or t
  modified_base (432)..(432): a, c, t, g, unknown or other
  misc_feature (432)..(432): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagacgaacgggccctcggtactgatgaaagtctttaagtagtgagtcggccaccctacgaaccggaaggggacgacgggactcccgtgactccgtcttcgcgacggcctccnggtcctcggtcggggctggacgccgtactaccctacacctactcctaccgacgtcccctcagtctaggaacggtntaggagtcgtacgtactttaattcgtgtcgaggtacgggtcggggacctggttcggtcggtttggggtaacgttcgggggcgggtaacgggaccgtaagggtccgttaccggttccggttaccgtaagggtcccgaacggtccccgaagggttccctcccgggcccccgttcgg

SEQ ID NO: 315756 - DNA, 612 bp, Homo sapiens
  misc_feature: GZ8MTXP01AB78F.38.7.A07.1.454.CMB.2.raw
  modified_base (276)..(276): a, c, t, g, unknown or other
  misc_feature (276)..(276): n is a, c, g, or t
  modified_base (358)..(358): a, c, t, g, unknown or other
  misc_feature (358)..(358): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacatcagccagagaacggcctaggtactgatgaagtcttaanagtgatggaccacccgtacgaaccgaaggggacgacgggactcccgtagtacctcggtcttcgtacgacggtcccttaccgnggtccgttcgggtgggggtcctgggacggccgtaccctaccctcaccctatccctacccgacgtcccctaccgagttccgtaggaaggtattacgggacggtcgttagtaacctttattaccgtgtaccgaggtaccggtggggcctacggtcggtccgggtttgggtaacgttcggggacgggtacggaaccgtaaggtccgttcggttacccgttcgtaaggcaacggcccgtaggccgtccgccccgttcg

SEQ ID NO: 315757 - DNA, 527 bp, Homo sapiens
  misc_feature: GZ8MTXP01DIXA5.38.7.A07.1.454.CMB.2.raw
  modified_base (341)..(341): a, c, t, g, unknown or other
  misc_feature (341)..(341): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaagggccctggtacttgatgaagcttaatagtgatcgggcaccgtcaaccgaaaggggcgacgggactcccgtgatcgcttctcnggctccagctcgtggggctgacgcgctacctcacatctccagcctcagtctgacggatgagctagactattactgtacgagtacggtggggctagtcgtccggtttggggtacgttcgggcgggtagggacccgaaggccgtaacggacccgttccgtacgggtacgaccggtccgaacggtcccg

SEQ ID NO: 315758 - DNA, 555 bp, Homo sapiens
  misc_feature: GZ8MTXP01D4IZR.38.7.A07.1.454.CMB.2.raw
  modified_base (173)..(173): a, c, t, g, unknown or other
  misc_feature (173)..(173): n is a, c, g, or t
  modified_base (279)..(279): a, c, t, g, unknown or other
  misc_feature (279)..(279): n is a, c, g, or t
  modified_base (339)..(339): a, c, t, g, unknown or other
  misc_feature (339)..(339): n is a, c, g, or t
  modified_base (452)..(452): a, c, t, g, unknown or other
  misc_feature (452)..(452): n is a, c, g, or t
  modified_base (536)..(536): a, c, t, g, unknown or other
  misc_feature (536)..(536): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgcatcgcatggcatcaacatcagccagagaacggccctggtacttgatgaaagcttaanagtgatcggaccaccgtacgaaccgaaggggacgacgggactcccgtgactccgtcttcncgacggtcctaccgaaggtctcgggtcgggggctgggacgccgtacctaccctcaccatccaccacgtccctcagttcgaggagtataggacggtctacgtaacttattacgngtcgaggtacggtgggctacggttcgtaccgggtttgggtaacgtcgggacggtacggacaggcttacggccgttcgaaggtcncgccagcctccgcccgtcg

SEQ ID NO: 315759 - DNA, 814 bp, Homo sapiens
  misc_feature: GZ8MTXP01CAG6F.38.7.A07.1.454.CMB.2.raw
  modified_base (240)..(240): a, c, t, g, unknown or other
  misc_feature (240)..(240): n is a, c, g, or t
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaanatcagccagagaacgggccctggtacttgatgaaagtcttaatagtgagtggaccacccctacgaaccgaaggggacgacgggtactcccgtagacctccggtctttcgtacgacggtcccttacccgaaggtccgttcgggtcggggggtaccttcggggaaccggcccggtacccttaacccgttaccgaaaccccgtaacgttccctaaccccgaaccggtccccttacccgtaacggttcccgtagggaacgggtaacgttagggaacggggttaccgttaacgggttaaccttttaaacgtttaaacccggttggttaacccggaacggggttaccggggttacggggggtacccttaaccggggtttacgggttccccgggggtttttaggggggtaaccggtttccggggggttaccgggggaaaccgggggttaacccggtaaacgggttcccggtttaaccggggttaccccgggtttacccggttaacgggggttaccctaaccggggtaacccccggaacggggttccccggttccccgggttccccccccgtttaaccgggg

SEQ ID NO: 315760 - DNA, 580 bp, Homo sapiens
  misc_feature: GZ8MTXP01AT2F5.38.7.A07.1.454.CMB.2.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagaggaacggccctcggtactgatagaagtcttaatagtgatcggcaccctcaacgaagggagacgggatcccgtgactcgcttcgtcaggcctcngctcgngggctgacgcgcctacctcaccatcctccgagtcccctcagtctaggacgatggaagcgttagacttagttacgtgtacgaggtacggtcggggtcctaacggttcggtacccgggtttggggtaacgttcgggggacggggtacgggacccgtaaagggtccgttacgggttccgttaccggtaacggaccgaaccggtaccccgacgggttccctcccggcccccgttccgg

SEQ ID NO: 315761 - DNA, 610 bp, Homo sapiens
  misc_feature: GZ8MTXP01EC20M.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcaggtggcacagcagcaacgcatcgcagtcggacatacaaacatacgagaccaaggaacggaaacgggtcccctacggttactagagtagaagtacttaaagtagtgagtcggaccacccgtacgaaaccgaaggggacgacggtacctcccgtagactcgtcttacgtacgcggcctaccgacgtcctcgggtggggctcggacgccgtacctacctcaacctactacccgtccacgtccctcgacgtcgtaggagtacggtggacggtactacgtacttacgtacgtgtacgaacggtcggtacgggctacggtcggttcgggtttagggtacggttccgggacgggtaacgacgacgcgtcggtaccgtcgtcggaccgaccgtccgaacgtccccg

SEQ ID NO: 315762 - DNA, 547 bp, Homo sapiens
  misc_feature: GZ8MTXP01B6N1F.38.7.A07.1.454.CMB.2.raw
  modified_base (418)..(418): a, c, t, g, unknown or other
  misc_feature (418)..(418): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaatagtgatggcaccctcaaccgaagggagacgggactcccgtgactcgcttctcgcggctccgagtctcgtggggctgacgcgcctacctcaccatcctcacgccctccagtctgaggcgtggacggctagtactntacgtgtacgaggtacgtcggggacctacgtggtcccgggtttgggtacgttccggggacgggtacggggacccgaaggttccgtcggtacccgtccgttacgggtcgaccggtccccgaaggtccccg

SEQ ID NO: 315763 - DNA, 529 bp, Homo sapiens
  misc_feature: GZ8MTXP01CV6ZW.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagcttaatagtgatggccaccctcaaccgaagggagacgggatccctgactcgcttctcaggcctccngctcgtggggctgacgcgcctacctcaccatcctccacgcctccagtctgagatgaggctgacttattactgtccgaggacggtggggctacggttggtccggtttgggtgttcgggcgggacgggaccgtaaggcgttacggccgttccgtaagggtccgaacggcccgaggccctccggccccgtccgg

SEQ ID NO: 315764 - DNA, 605 bp, Homo sapiens
  misc_feature: GZ8MTXP01ACXZG.38.7.A07.1.454.CMB.2.raw
  modified_base (158)..(158): a, c, t, g, unknown or other
  misc_feature (158)..(158): n is a, c, g, or t
  modified_base (181)..(181): a, c, t, g, unknown or other
  misc_feature (181)..(181): n is a, c, g, or t
  modified_base (249)..(249): a, c, t, g, unknown or other
  misc_feature (249)..(249): n is a, c, g, or t
  modified_base (404)..(404): a, c, t, g, unknown or other
  misc_feature (404)..(404): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctntgcctctgcctcccgtggggacncctcggtcacgctcacctgccactctgagcaggtggcacagcagcaacgccatcgcatggcatcaacntcagccaagacggaacggcctggtacttgatagaagtcttaaagtgtgacgtcggacccaacccgtcgaaccgaaggggacggacggtacctcccgtgactccgctttaccgcgcggtcctcgagtcgtcggtggggctgaccgtcgacctaccncaacctctccctacacgtccctcgacgttcgaggacggagtacggacggtctacgtacttacgttacgtcgttacggaacgggtcgggtacgggactaccggtcgggtccgggttttaggggacgttcgggggacggtaacgggaccgttacggccgtaacggacccgtcgtacggccgaccggcccgttaacggtccccg

SEQ ID NO: 315765 - DNA, 657 bp, Homo sapiens
  misc_feature: GZ8MTXP01AZ8DT.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaaggacgaacggccctcggtacttgatagaagtcttaaagtagtgatgggccaccctacgaaccgaaaggggacgacgggtacctcccgtagacgtccgtcttcgtacgaacggtcctccgagtccgtcggttcgggggctacgggacgccgtacctacccgtacaaccctactcctacccacggtccccttccgaacgttcgtacgggaacgggtaggtcgggacgggtacgttacggtaacttaacgttacgtacggttacgacggtcgggttacggggctaacggttcgggtttcgggtttacggggtacggttcggggacggggaacgggttaccgttaacggttcgtaaccggtacccggtaaccggttacgggtacccaccggcccgttaacggtccccg

SEQ ID NO: 315766 - DNA, 680 bp, Homo sapiens
  misc_feature: GZ8MTXP01DOG84.38.7.A07.1.454.CMB.2.raw
tcagtcgatcacgtcacgaccggtgctcgatttagcacgtgtcgcaggggagagctctgggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgcatcgcatggcatacaacatcagccaagacggaacggccctggtacttgatagaagcttaatagtgagtcggaccaccctcgaaccgaaggggagaaccgggacctcccgtggactccgtccttaccgtcgaacggtcctacccgacggtccgttcgggtcggggggtcttacgggaccggtcccggtacccttaacccgttacccaacccgtacttaccccgttcccaaccgggtcccctacccgtaacgttccgtaggtaacgggtagggttacgggacgggtaccgtacggttaacttaacgtttacgttcggtacgtacgggtaccggggttcggggaccgtacggttcgggttccgggttttaggggtacggtttcggggacggggtaacggaaccggacgttacgtcggtaccgtcgtacgggtccgacgtcccgaacggtccccg

SEQ ID NO: 315767 - DNA, 722 bp, Homo sapiens
  misc_feature: GZ8MTXP01C6TAZ.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatagaaagtcttaaagtagtgatcggaccaccctacgaaccgaaagggtagaccggggtactcccgtaggaaccctccggtacttcgtaccgtacgggtcccttacccgaacgggtccttccgggttacggggggccttacggggaaccggtccccgggtacctttaacccccgtttaccgaaaccccgtacgttacccctaccccgtaaacgggtcccctacccgtaacggttacccgttgggaaaggtacgttacgggacgggtaccggttaacggtaaacctttaacgtttacgtacggttaccggacggtacgggtaacgggggtctaaccggttcggtcccgggttttggggtaaacgttccggggacgggtaacgggaccgtaaaggtccgttacggccgttaccgtaaggtacgaacgaccccgaaggttcccgtccgccccgttaaccgg

SEQ ID NO: 315768 - DNA, 588 bp, Homo sapiens
  misc_feature: GZ8MTXP01C8O78.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacggccctggtacttgatagaagcttaatagtgatggaccacccgtacaaccgaaggggacgacgggactcccgtgatcgcttactcaaggctcagcgtcgtggggctgacgcgctacctcaccactctccagtccctcgagtctagaggagtggaacggtctagaacttagttaaccgtgtacgaggtacggtcgggtaccgacgttcgggttcccgggttttagggggttacgttaccgggggacgggtaacggggacccgttaagggttccgttaacgggacccggttccgtacgggtaccgaccgggaacccgttaacgggtccccg

SEQ ID NO: 315769 - DNA, 655 bp, Homo sapiens
  misc_feature: GZ8MTXP01AH4FR.38.7.A07.1.454.CMB.2.raw
  modified_base (240)..(240): a, c, t, g, unknown or other
  misc_feature (240)..(240): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacntcagccagaggacggccctggtactgatgaagtcttaaagtgtgatcggacctacccgtacgaaccggaagggacgacgggactcccgtagtacctccggtacttcgacgaggtccctccgaagtccgtcgggtcgggggctacgggacgtcccgtacccttacccgtaccaaccctatcccctacccgacggtcccctaccgtacgtccgtagggaacgtacgtcgggaacgtccgttaacggtaactttacgttaaccgtgtacgagggtaccgggttacggggcctacggttcggtcccgggttttagggtaacgttcggggacgggacgggttaaccgacggtcgttccggttaccgttaccgaaggtaccgaaccggacccgacggttccctccggttcccccgttccgg

SEQ ID NO: 315770 - DNA, 578 bp, Homo sapiens
  misc_feature: GZ8MTXP01CN1NF.38.7.A07.1.454.CMB.2.raw
  modified_base (355)..(355): a, c, t, g, unknown or other
  misc_feature (355)..(355): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaaacatcagccagagaacggccctggtacttgatgaagcttaagagtgatggccacccgtacaccgaaagggagacgggactcccctgactccgcttctcaaggctcagctcgnggggctgagcgctacctcacctagtcctaccagtccctcacgttctgggaagggacgttgggaacgggtccttaggaactttacgttaaccgtggttaccgaggtaccgggtggggtacctacggttcgggtaccggtttggggtacgttcggggacgggtacgggaccgacgggcgtcgggacccgttccgtacgggtccgacggtccccgaacgggtcccg

SEQ ID NO: 315771 - DNA, 670 bp, Homo sapiens
  misc_feature: GZ8MTXP01BU4J2.38.7.A07.1.454.CMB.2.raw
  modified_base (360)..(360): a, c, t, g, unknown or other
  misc_feature (360)..(360): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacatcagccagagaacggcctggtactgatgaaagtcttaatagtgagtcggccacccgtacaaccggaaaggggacgaacgggtactccccgtagacctccgtacttcgacgacggtcctaccgnggtccgtcggtcggggcctaggacgtccgtaccttaccctaccgaaccctactccctccgaacgtccctccgaagtccgtaggacggtatcgggaacggtcgttaaggtaaccttacgttacgtggtaccgtacgggtaccggttacgggggcctaacgggttcgggttccggggttttcggggttaacgggttcccggggacggggtaaacgggttacccggtaaggtccggttacgggttacccgttccgttaacgggtaccgaacggtaccccgtagggttcccgtcccggttcccccgttaaccgg

SEQ ID NO: 315772 - DNA, 580 bp, Homo sapiens
  misc_feature: GZ8MTXP01CKYJ1.38.7.A07.1.454.CMB.2.raw
  modified_base (238)..(238): a, c, t, g, unknown or other
  misc_feature (238)..(238): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaanatcagccagagacgggccctggtactgatgaagtcttaatgtgatggaccacctcaaccgaagggagacggatcccgtgacctcggcttctcaggctccngtcgtcgnggggactgacgcgctacctcaccactcctccacgccctccgtacgtctggagattggaacggtcgtaggtaactttacttaacgtgtcgaggtacggttcggggctacggtggtcggtttggggtaacgttcggggacgggacgggttaaccgaacggtccgttacggttacccgttcggttaacggtacgaaccggacccggtaacgggttcccgtccggcccccgttcccgg

SEQ ID NO: 315773 - DNA, 605 bp, Homo sapiens
  misc_feature: GZ8MTXP01CCRBF.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaaacgggcccctaggtacttagatgaaagcttaaagtagtgatttcggaccacccgtacgaaccgaaaggggacgacgggacctcccgtagactcgtcttactcaaggcctaccgagcctcggtggggctgacgcgctacctcaccatcctccgacgccctcgagtcgtagacggtagttcggaggtctaggtaccttaagttaccgtgttacgaggtaaccgggttggggcctaacggttcgggttcccggtttaggggtacgttcggggacgggtaacgggaccgttaacggttccgtaacgggtacccgttccgtacggtaccgaccggtcccgaacgggtccccg

SEQ ID NO: 315774 - DNA, 771 bp, Homo sapiens
  misc_feature: GZ8MTXP01D2884.38.7.A07.1.454.CMB.2.raw
  modified_base (172)..(172): a, c, t, g, unknown or other
  misc_feature (172)..(172): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgccatcgcatggacatcaacatcagccagagaacggccctggtacttggatgaaagtcttaaatagtgaatggaccacccgtcgaaccgaaggggacaacgggtactcccgtaggaccttccggtctttctaccgaacgggtcccttcccgaaggtcctcggtcgggggctacgggaacgccgtacctaccctcaacctactcctacccaaggtcccctacccgtaaggttccgtaggaaacggggttacgtacgggtacggtaccgttaacggtaaccgttttaacgtttaccggtacggttaccggaacggggttaccggggttaccgggggtaccttaccggggtttccggggtttacccggggttttaacgggggttaaccgggtttaccggggggaacccgggggtaaaccgggttaaacccgtaaacggggttacccggttaacccggggttaaccccggttacccggttaacggggtaccccgtaaacccgggtaccccgggtaacgggttccccgttcccccgggttaaccccccggtttcggg

SEQ ID NO: 315775 - DNA, 685 bp, Homo sapiens
  misc_feature: GZ8MTXP01BYMQ5.38.7.A07.1.454.CMB.2.raw
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacntcagccaggagaacgggccctggtactgatgaaagtcttaanagtgaagtcggaccaccccgtacgaaccgaaaggggacgacgggactcccgtgactccggtcttctcgacggtcctccgaagccttcgggtagggggcctgggacgccgtccttaccctccacctactccctccagtcccctaccgagtccgtaggacggtagtacggacggtacttacggtaacctttaagttaccgtcggtacgtaacgggtaccgggttgggggaccttacgggttcgggttcccgggttttgggggtaacggtttccgggggaccgggggtaaacgggaccgaaacgggtccggttaccgggttaccccggtttaccggttaacggggtacccgtaaccggtccccgggaaacggttccccgttccccgggttcccccggtttcccggg

SEQ ID NO: 315776 - DNA, 559 bp, Homo sapiens
  misc_feature: GZ8MTXP01BE8X7.38.7.A07.1.454.CMB.2.raw
  modified_base (158)..(158): a, c, t, g, unknown or other
  misc_feature (158)..(158): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctntgcctctgcctccctgggagcctcggtcacgctcacctgcactctgagcagtgggcacagcagcaacgccatcgcatggcatcaacatcagccagagaacggccctggtactgatgaagtctaatagtgatcggcacctnacgaagggngacggactcccgtgactcgcttcncngctcagctgtggggctgacgcgctactcaccatcctccagccctcgagtctaggacggtagtggaacggtcctaggtaacttaagttaccgtggtaccgtaagggtccgggttcggggacctacggttcggttccggggtttgggggtaacgttcggggacggggaaggacccgaggccgtaacggtacccgtcgtacgggtacacggtaacccgaacgggtcccg

SEQ ID NO: 315777 - DNA, 646 bp, Homo sapiens
  misc_feature: GZ8MTXP01A72G9.38.7.A07.1.454.CMB.2.raw
  modified_base (356)..(356): a, c, t, g, unknown or other
  misc_feature (356)..(356): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgcatcgcatggcatacaacatcagccgaggacggaacgggccctcggtacttgatagaaagtctttaaagtagtgagtcggaccaccctacgaacggaaggggagaccgggactcccgagtaccgtccggtcttcncgacggtccctaccgaaggtccgtcgggtgggggctagggacgtccgtaccctaaccctctaaccctactcctaccgacgtcccctcgtagtcgtaggacggtaagtcggaggtcttaggtaactttaacgttaccgtagtacgacggtacgggtcgggtaaccttcggtcggttccggtttggggtaacgttccggggacgggaacgggttaccgaaggtccgttacggttaccgttaccggtaacggtcaaccggacccgacggttcccgtcccgttccccgttccgg

SEQ ID NO: 315778 - DNA, 675 bp, Homo sapiens
  misc_feature: GZ8MTXP01ALG1G.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccagagaacgggccctggtacttgatgaaagtcttaagtagtgagtcggaccaccccgtacgaaccgaaagggggacggacgggactcccgtggacctccgtcttcgtccgaggccctccgaagtccgtcgggtgggggcctggacgtccgtaccttacccctaccaaccctactccccgtaccgaaccggttccccctaccgtacggttacccgtagggaacggtacgtacgggtaacgggtccttacggtaactttacgttaacgtcggttacgacggtcggtacggggactcggttcggttacccggggtttgggtaacgttcggggacgggtaacggaccgaaggtcgttaccggttcccggttaccgttaacgggacctaaccggacccgtaacgggttcccgtaaccccggttcccccgttccgg

SEQ ID NO: 315779 - DNA, 621 bp, Homo sapiens
  misc_feature: GZ8MTXP01D58SN.38.7.A07.1.454.CMB.2.raw
  modified_base (172)..(172): a, c, t, g, unknown or other
  misc_feature (172)..(172): n is a, c, g, or t
  modified_base (238)..(238): a, c, t, g, unknown or other
  misc_feature (238)..(238): n is a, c, g, or t
  modified_base (376)..(376): a, c, t, g, unknown or other
  misc_feature (376)..(376): n is a, c, g, or t
  modified_base (463)..(463): a, c, t, g, unknown or other
  misc_feature (463)..(463): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtggcacagcagcaacgcatcgcatggcatcaacntcagccagagaacgggccctggtacttgatgaaagtcttaaagtagtgagttcggaccacccgtacgaaccggaagggggacggaaccgggtactccccgtaggacctccggtcttcgtaccgacggtccctacccgnggtcgtccgggttgggggacctgggacggcgtacccttaccctcaccctactccctaccacgtaccctcctaggttccagggacgtntacggagtctaggtaccttagtcgtcgtacgacggacggttcgggccttacggttcggttccggttggggtaacgttcggggacgggtacggacgaacgtcgttaccggttccgttacgtaaggcgaacgccgacggttcctcccgttccccgttccg

SEQ ID NO: 315780 - DNA, 569 bp, Homo sapiens
  misc_feature: GZ8MTXP01B8OS8.38.7.A07.1.454.CMB.2.raw
  modified_base (342)..(342): a, c, t, g, unknown or other
  misc_feature (342)..(342): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagcttaatgtgatggccaccctcaacgaagggagacgggatcccgtgactccggcttcgccgaggtcctccngccgttcgtgggggctggacgtccgacctacccgtcaaccctactcctccacgtacccctcgagttcgtaggacggtatgggacggtcgttagtacttacgttacgtgtccgaggtacgggtcgggctacgtcggtccggtttgggtaacgttcggggacgggacgggcgaacggtcgttacgccgttcgtaaggtcgaacgtcccgaggttcctccgccccgtcgg

SEQ ID NO: 315781 - DNA, 725 bp, Homo sapiens
  misc_feature: GZ8MTXP01B6PYC.38.7.A07.1.454.CMB.2.raw
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtgggcacagcagacaacgccatcgcagtggacataccaaacataccagacccaaggtaacggaacgggtcccttacgggtacttggaagttagaaacgtactttaaagtagtagacgtcgggaccctaccccgtacgaaaccggaaagggggacgtaaccggggtactcccgtagtaacccttccggtacttcgtcgacggtaccctcccgaagtccgttcgggtcgggggtacctagggaaccgtccgtacccttaacccgtaccctaaacccgtcttacccctaccgtacccggtaccccttacccgtaacggttcgtacgggaacggtagtacgggaacggtaccgttaacggtactttacgttacgtacgtaccggtacgggtaccgggtcggggtcgtacggttcgggtccgggtttgggtaacggtcggggacgggtacgggacgaaacggtcgttaccggttccgttaccggtaacggcaaccgtccggacgttccgtcccgttcccgtccg

SEQ ID NO: 315782 - DNA, 679 bp, Homo sapiens
  misc_feature: GZ8MTXP01A0PQC.38.7.A07.1.454.CMB.2.raw
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcaggtgggcacagcagacaacgccatcgcagtcggacatacaaacatacagaccgaaggaacggaacggcccctaggtacttagatagaagtacttaagtagtgagtcggaccaccctacgaaccgaagggacgacgggtacctccgngactccgtcttacncgcggctccgagtcgtcggtcggggctacggacgccgtaccttacccgacctacctactcccctaccgtaccggtccccttacgacgttccgtaggtaacgggtacgtacgggtaacggtccgttaacggtaaacctttacgttacggtacggttaccggtaacggtaacggggtcggggtaactccggttaacggggttcccggggtttaggggtaacgttccggggacgggtaacgggttaccgttaacggttccggtaaccggtaaccggttccgtacgggacgaccggtaacccgaacggtccccg

SEQ ID NO: 315783 - DNA, 601 bp, Homo sapiens
  misc_feature: GZ8MTXP01E0YC8.38.7.A07.1.454.CMB.2.raw
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcacatcagccagagaagggcccctcggtactgatagaagcttaatagtgatggcaccctcaaccgaaggggagcggacctccctgatcgcttctcaaggctccagctcgnggtctgagcgcctacctccaccactcgtaccncgtacccncgaccgtcgacgtacgtacgggacttacggtaccgtcgtaccgttacgtaccgtacgttacgaccgtacggtacggtaccggtacggtcggtcgtttacggttacgggttcgttaccgggtactttacgggaccggttaccggtaacccggtaccggttaacccgttaccggtcccggttaccgtaaccccggaacggtaaccccccggg

SEQ ID NO: 315784 - DNA, 599 bp, Homo sapiens
  misc_feature: GZ8MTXP01CMJRH.38.7.A07.1.454.CMB.2.raw
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (402)..(402): a, c, t, g, unknown or other
  misc_feature (402)..(402): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagaggaacgggccctacggtacttgatgaagtcttaatacggtgaatcggaccacccgtacgaaccggaaggggacgacgggactcccgtgacctcgcttcncgacggcctccgngtctcgggtggggctaggacgcgacctacctcaccacttccnccgacgtcctcgagtccgtaggacgtagtggaacggtctacggtaactttagttacgtcgtacgagggtacgggtggggacctacggttcggttccggtttggggtaacgttcggggacgggtaacggaccgaaggtcttaccggttaccgttcgttaacggcgaaccggcccgacggttccctcccgccccgttcg

SEQ ID NO: 315785 - DNA, 699 bp, Homo sapiens
  misc_feature: GZ8MTXP01CPYYL.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagcagagaacggccctaggtacttgatagaagtactttaaagtagtagagtcgggaccaacccgtacgaaccggaaaggggacgaaccggggtaccctcccgtagtaacgtccgcctttaccgtacgaacgggtcccttacccgacgggtccgttccgggtcgggggtactacgggaccgtcccgtaccctacccttacccaacctactcccttacccgaaccgtcccctaccgtacgttaccgttagggaaccgggtagtacgggtaacggtccgttacggtaacttaacgttaccgtagtacgaacggtcgggtacggggtcctaacggttcgggttccgggtttaggggttacggttccggggtaacggggtacgggaaccgttaacgggttccgtaacggtacccggttaacgtacggtccgttaccggaacccgttaacgggtccccg

SEQ ID NO: 315786 - DNA, 745 bp, Homo sapiens
  misc_feature: GZ8MTXP01DJT97.38.7.A07.1.454.CMB.2.raw
  modified_base (240)..(240): a, c, t, g, unknown or other
  misc_feature (240)..(240): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctccagcttgtgctgactcaatcgccctctgcctctgcctcccgtgggacgcctcggtcacgctcacctgcactctgagcagtgggcacagcagacaacgccatcgcatggcatcaanatcagccagagacggcctaggtactgatagaagcttaaatacgtagagtcggacctaccctacgaaccgaagggacgacggactcctagacctccggtactttcgacgacggtcctaccgaacggtccgttcgggtcgggggtccttacgggacgacccggtacccttaaccccgtaccctaacccgtaacgttcccctacccgtaccggtaccccttacccgtaacggttacccgttaacgggagggtaaccgttagggaaccgggtaccgttaacggttaaaccgtttacgttaaaccgtcggtttaaccggaacgggttaccgggtacgggggtacccttaaccgggttcggttaccccggggttttaggggtaaccggttacggggaaacggggtaacgggttaaaccgtaaacgggtccttaccgggttacccggttacgttaacgggtcccgaaccggtaccccggaaggttccccgtaacccggttcccccgttccgg

SEQ ID NO: 315787 - DNA, 724 bp, Homo sapiens
  misc_feature: GZ8MTXP01BZT6X.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgccctcccgtgggagcctcggtcacgctcacctgcactctgagcaggtgggcacagcagacaacgccatcgcagtcggacatcaaacatacagacccgaaggaacggaacgggtcccctaggtacttaggaagttaggaaagtactttaaagtaggtgaacgttcggaccctaaccccgtacgaaaccggaagggggacgaaccgggtactcccgtagaccgtccggtcttcgtacgacggtcctacccgaaggtcccttcgggtcggggctacggacgtccgtaccctaccctccaacctactccctaccgacgtcccctaccgagttccgaggagacgttaggacgttcgtaggtaactttaacgtcgttacggtccgaagggttaccgggtacggggtccttaaccgggttcgggttacccgggttttgggggtaacccgttcgggggaccgggtaacggggaaacccgtaacgggtcgttaaccgggttcccgttaccgggttaaggacccgaaccggaccccggtaagggttcccccgtcccgttccccccggttccggg

SEQ ID NO: 315788 - DNA, 627 bp, Homo sapiens
  misc_feature: GZ8MTXP01DPBGO.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctgcctccctgggacgcctcggtcacgctcacctgcactctgagcaggtgggcacagcagcaacgccatcgcatggacatcaacatcagccaagaacggaacggcccctaggtactgagtagaagtcttaaagtgtgagtcggaccaccctacgaacgaaggggagaccgggtacctcccgtgacgtcgtccttactcgcggtcctaccgagtccgtcggtcggggctaggacgtccgacctaccctacacctacgttcctaccgacgtcccttacgacgttcgtagggacgtacgggtacggacggtactagtacttaacgttacgtcggtacgaggtaccgggtgggtactcggttcggttccgggtttggggtaacggttcggggacggggtacgggttaccgacggttccgtaacgggacccggtcgtacgggtaccgaccggtcccgaacggtccccg

SEQ ID NO: 315789 - DNA, 589 bp, Homo sapiens
  misc_feature: GZ8MTXP01CSZ5N.38.7.A07.1.454.CMB.2.raw
  modified_base (173)..(173): a, c, t, g, unknown or other
  misc_feature (173)..(173): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccgtgggancctcggtcacgctcacctgcactctgagcagtgggcacagcagcaacgccatcgcatggacatcaacatcagccagagacgggcctaggtactgatgaantaanagnatcggcacctacgaacgaagggacgacggactccgtagacctcgtcttcacgacggcctccnggtctcgtgggggctaggacgccgtacctacctccaacctactcctacccaacgccctaccgtagtcgtaggagtataggacggtctagtaaccttaattacgtgtaccgaggtacggtacggggctacggttcggtccgggtttagggtaacgttcggggacggggtaacggaccgtaaacggtcgttacggttcccgttacgtaacggaccgaacgacccgaaggttccgtccggttccccgtcg

SEQ ID NO: 315790 - DNA, 626 bp, Homo sapiens
  misc_feature: GZ8MTXP01E3X91.38.7.A07.1.454.CMB.2.raw
  modified_base (178)..(178): a, c, t, g, unknown or other
  misc_feature (178)..(178): n is a, c, g, or t
  modified_base (245)..(245): a, c, t, g, unknown or other
  misc_feature (245)..(245): n is a, c, g, or t
  modified_base (407)..(407): a, c, t, g, unknown or other
  misc_feature (407)..(407): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgcatcgcatggcatcaaacntcagccagagaacggccctggtacttgatagaagtcttaaagtagtgagtcggaccacccgtacgaaccgaaaggggacggacggggactccccgtagacgtccgtcttcctacaacggcctccgagctcggtgggggctgacgcgcctacctcaccatccnccacgccctacgacgtccgtagaggagtaggacggtactacgtaacttaagttacgtacggttacgacggtaacggggttcgggggacctacggtcgggttcccgggttttgggggtaacgggtttcggggaccggggtaacggggacccgttaaaggcccgttaacgggaccgttaaccggttacggtaccgaccggtaacccgaacgggttccccgg

SEQ ID NO: 315791 - DNA, 653 bp, Homo sapiens
  misc_feature: GZ8MTXP01E0U7B.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcacatcagcagagacggccctcggtactgatagaagtacttaagtagtgacgtcggacccacccgtacgaaaccggaaagggggacgacggtaccctccccgtagtactccggtcttaccgtacgaacggtccctaccgacggtccgtcgggtcgggggtctacggacgtccgaccctacctacccaacctacctcccgtaccgaccggtcccctaccgtacgtacggtagtaaccggtagggtacgtacggtaccgttacgtacttacgttacgtacggtaccggtacggtccgggtacggtccggtacggtccggttcgggttacgggttaccggttacggtacgggtaccttacggaccgttccgtaaccgtccgtaacggtacgtccgaccgaacccgttcgtccccg

SEQ ID NO: 315792 - DNA, 639 bp, Homo sapiens
  misc_feature: GZ8MTXP01AUV6D.38.7.A07.1.454.CMB.2.raw
  modified_base (356)..(356): a, c, t, g, unknown or other
  misc_feature (356)..(356): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtactgatagaaagtcttaaagtagtgagtcggaccacccctacgaaccgaaggggagacgggactcccgtgacctcgcttcgtcgacggcctcngcgtcgtggggctggacgcgcctacctcacctactcctccgacgccctcgacgtcctggagtagtggaggtcctaggtaccttaagttaccgtggtacgacggtacgggtcgggggtacctaccggttcgggttacccgggttttgggggtaacgtttcgggggaccggggtaaacggggacccgtaaacgggtccgttacggttaccccggttaccgttaacgggtccgaaccggaccccggtaacggggttccccgttcccgggttccccccgtttccggg

SEQ ID NO: 315793 - DNA, 538 bp, Homo sapiens
  misc_feature: GZ8MTXP01BIE8J.38.7.A07.1.454.CMB.2.raw
  modified_base (339)..(339): a, c, t, g, unknown or other
  misc_feature (339)..(339): n is a, c, g, or t
  modified_base (389)..(389): a, c, t, g, unknown or other
  misc_feature (389)..(389): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggcctcggtactgatgaagcttaatagtgatggccaccctcaaccgaagggagacgggactcccgtgactcgcttctcaggctcngctcgtggggctggacgcgctacctcaccatctccagcctcagtctgagntgacggctagtacttatacgtgtcgagtacggtggggctacgtcggtccggtttgggtaacgttcgggacgggtacgggaccgaaggtccgttcggaccgttcccgtaaggtccgaacggccccgtaaggccctccggcccccgttcgg

SEQ ID NO: 315794 - DNA, 623 bp, Homo sapiens
  misc_feature: GZ8MTXP01CG3V5.38.7.A07.1.454.CMB.2.raw
  modified_base (245)..(246): a, c, t, g, unknown or other
  misc_feature (245)..(246): n is a, c, g, or t
  modified_base (342)..(342): a, c, t, g, unknown or other
  misc_feature (342)..(342): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgcatcgcatggcatcaacnncagccagagaacggccctggtactgatgaagtcttaatagtgatcgggacacccgtgaaccgaaagggacgacgggacctccgtgactcgcttacncgcggcctccgagtccgtcgggtcggggtctcggacgtccgtacctaccctaccacctactcctaccgaccgtccctaccgtagtccgtaggaacgggtacgtacgggtacggtactacggtaactttacgttaccgtgttaccggaggtaccgggttcgggtaccgtacggttcgggttaccgggttttaggggtacggttccggggaacgggtacgggaaccgaggttccgtaacggtacccgtccggtacggtacgaccggtaaccgaacggtccccg

SEQ ID NO: 315795 - DNA, 589 bp, Homo sapiens
  misc_feature: GZ8MTXP01A9VJA.38.7.A07.1.454.CMB.2.raw
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatagcatggcatcaacatcagccagagaacgggccctggtacttgatgaagtcttaagtagtgagtggaccaccctacgaaccgaaggggacgacgggactcccgtgactccggtcttcncgacggctccgngtcctcggtggggctggacgccgtctacccncaccatcctccgacgtcccctactagtctaggagataggagcgtagtacttaattacgtgtacgaggtacggtggggacctacggttcgggttcccggttttggggtaacgttccgggggacgggtaacgggaccgaagggtccgttacggacccgttcgtaacgggtccaacggacccgaggttcccgtccgttccccggtcg

SEQ ID NO: 315796 - DNA, 660 bp, Homo sapiens
  misc_feature: GZ8MTXP01CP68Q.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtggcacgagcagcaacgcatcgcagtcggcatacaacatcacgccaaggaacggaacgggtccctacgggtacttagagtagaagtacttaagtagtgtagtcggaccaacccgtacgaaccgaaaggggacgacgggtacctcccgtagacgtcgtcttacgtacgaacggtcctaccgacggtccgtcggtcgggggctacgggacgtcccgtacctacccgtaccaaccctactccgttacccgacgtccccgtacgacggtaccgtaggaacgggtaggtacgggtacgggtactacggttaaccttagttaccgtcgtaacggtacggtacggtcggggacctacggttcgggttccgggtttagggtacgttccggggaagggtacggaccgacggttccgttaacggacccggtcgtacggaccacggcccgaaggtcccg

SEQ ID NO: 315797 - DNA, 719 bp, Homo sapiens
  misc_feature: GZ8MTXP01EHPT8.38.7.A07.1.454.CMB.2.raw
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgccctcccgtgggagcctcggtcacgcctcacctgcactctgagcagtgggcacagcagacaacgccatcgcatggcatacaacatcagccaggaggaacgggccctaggtacttggatagaaagtctttaaagtagtagagtacggacctaaccccgtacgaaacccggaaagggggacgaaccggggtacttaccccgtaggtacctccggtcttccgtacgacgggtccctaccgaacggtccgttcgggtcgggggtctcggggtaacggccgtacccttacccgtcccaacccgtacttcccgtacccaccgtacccgtaccgtacgtacgtacggacggtagtacggtacggtacggtacgttaacgttaacgttacgtacgtacgtacggtacgggtacgggtcgtacggttcggttcgggtttcgggttaacgggttacggggttacggggtacgggttaaccggtaacggtacggttaccggttccggttaccggtaacggtaccgtaaccggacccggtaccggttcccgtcccggttccccggtcccg

SEQ ID NO: 315798 - DNA, 667 bp, Homo sapiens
  misc_feature: GZ8MTXP01C00CK.38.7.A07.1.454.CMB.2.raw
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgccctcctgggancctcggtcacgctcacctgcactctgagcaggtgggcacagcagcaacgcatcgnatggacatcaanatcagccagacgaaggccctggtactgatgaaagtcttaatagtgagtggaccaccctcgaaccggaaagggggacgaacgggactccgtagacctccggtacttcgtcgaggccttacgngtcgtcgggnggggtactggacgtccgaccttaccctcaaccctntcctaccacgccctactagtccgtaggaaacgtgtacggacggtacttacggtaacctttagtttaccgacggttaccggaacggttaccgggggttcgggggaccttaaccgggtttcgggtaccggggtttttggggtaaacggttccgggggaacggggttaacggacccgtaaacgggtccttaacgggccccgttaccggtgggtacccaaccgggtaccccgaagggttccgtccccgggttaacccccgttcgg

SEQ ID NO: 315799 - DNA, 635 bp, Homo sapiens
  misc_feature: GZ8MTXP01AGPWN.38.7.A07.1.454.CMB.2.raw
  modified_base (172)..(172): a, c, t, g, unknown or other
  misc_feature (172)..(172): n is a, c, g, or t
  modified_base (239)..(239): a, c, t, g, unknown or other
  misc_feature (239)..(239): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtgggcacagcagcaacgcatcgcatggcatcaacntcagccagacgaacggccctcggtacttgatagaagtacttaataggtgagtcgggaccaaccccgtacgaaccggaaagggggacggaccgggggtaactcccgtagtaacctccggtacttcgtaccgaggtccttaccgcgtcgtccggtgggggctggacgccgtacctacccgtcaccctatcctacccacgccctaccgagtcgtaggacgtagtggacggtactaggtactttagttaccgtagtccgaggtaccggtggggtctacggttcggttcgggtttggggtaacgttccgggggacgggacggttaacgaacgggtccgttcggaccggttccgtaacggtaccgccggtaccccgaggttcccgtcccggcccccgttcgg

SEQ ID NO: 315800 - DNA, 634 bp, Homo sapiens
  misc_feature: GZ8MTXP01DZQRO.38.7.A07.1.454.CMB.2.raw
  modified_base (158)..(158): a, c, t, g, unknown or other
  misc_feature (158)..(158): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctntgcctctgcctccctgggacgcctcggtcacgctcacctgccactctgagcagtggcacagcagcaacgcatcgacagtggcatcaacatcagccagagaacggccctcggtacttagatagaagtcttaaagtagtgagtcggaccaccgtacgaaccgaagggacgacggactccgtagactcgcttacgtcaacggctaccgacgtccgtcggtcgggggtctaggacgcgtacctacctaccacctactacctccgacgtccctcgacgtcgtacgaggtacgtaggacggtactacggtaacttacgttacgtcgttacgacggtacggtcgggacctacggtcggttaccgggtttggggtacggtttccggggacggggtaaccgggttaaccgttaacgggttaccgttcgggtaaccccgttaacggtaacggtacccggaccggtaaccccggaacggtcccccgg

SEQ ID NO: 315801 - DNA, 692 bp, Homo sapiens
  misc_feature: GZ8MTXP01BTL2Z.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaaacgccatcgcatggacatacaacatcagccaagacgaacgggccctcggtacttgatagaaagtacttaagtagtgagtcggacctaccccgtacgaaccggtaagggacgaccgggactcccgtagtaccgtcggtacttcgtacgacggtccctaccgaacggtccgttccgggtcgggggtaccttacgggaaccgggtccccggtacccctttaacccctacccgtaaaccccgtaaccgttcccccttaccccgaaccggttcccccgttacccggtaacggttccgttaacgggaacgggtaggttacgggtaccggtacgttaacggttaacctttaacgttaacgtcggtaccgaagggtacggtcgggggtctacggtcggtcggtttgggtaacgttcgggacggtacgggacgaggtcgttacgccgttcgtaacggtcaacgccgacggctccgccccgtcg

SEQ ID NO: 315802 - DNA, 788 bp, Homo sapiens
  misc_feature: GZ8MTXP01DXXU7.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggagcctcggtcacgctcacctgcactctgagcagtgggcacagcagcaacgccatcgcatggacatcaacatcagccaaggagaacgggccctggtacttggatagaaagtactttaaagtaggtagtaacgttcggacccctaccccgtaccgaaacccggaaagggggacggaccggggtaactccccgtagtacctccggtcttcgtcgacggtccctacgaacggtcgtcgggtcgggggtcctagggacgcccggtaccctacccttaccaccctaacttaccccgtaccgtaacccgtcccgttaccgtacgttacggtaagggtaacggtacggtacggtaacggttacggttaacgttaacgtttaaccgttaccggtacggtaaccggtaacggggttacggggttaccggggtaccgttaccgggtttaccgggttaccggggttttacggggtaacgggttaccgggggaacggggtaaaccggggttaaccgtaaccgggttcccggttaccgggttaccccggttaccgggtaaccgggtacccggtaacccggtaccccgggtaccgggttccccggttcccccggttcccccgggttaacgg

SEQ ID NO: 315803 - DNA, 574 bp, Homo sapiens
  misc_feature: GZ8MTXP01BOWUM.38.7.A07.1.454.CMB.2.raw
  modified_base (240)..(241): a, c, t, g, unknown or other
  misc_feature (240)..(241): n is a, c, g, or t
  modified_base (276)..(276): a, c, t, g, unknown or other
  misc_feature (276)..(276): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccgtgggagcctcggtcacgctcacctgcactctgagcaggtgggcacagcagcaacgcatcgcatgcatacaacnncagccagagacggcctggtactgatgaatcttaanagtgatcggccacctcgaacgaagggagacggactccgtgacctcgcttcncgaggcctcgngtctcggtggggctgcgcgtcctaccncaccactcctccacgtccctcgacgtcgtgaagatggagtcgtagtacttacttacgtacgtacgacggtacggtcggggtctacgggttcggttcgggtttggggtaacggttccggggacgggtaacgggaccgaacggtcgttacgttcccggttaccggtcggtaccgaaccgcccggtacggttccgtcccgttcccggttccg

SEQ ID NO: 315804 - DNA, 720 bp, Homo sapiens
  misc_feature: GZ8MTXP01B1CFV.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctccctgggagcctcggtcacgctcacctgcactctgagcagtggcacagcagcaacgcatcgcatggcatcaacatcagccagagaacggcctaggtactgatgaaagtcttaagagtgacgtcggaccacccgtacgaacccggaagggggacgaccgggtactccccgtagtaacctccggtactttcgtaccgacggtccctaccgaacggtccgttccgggttcgggggccttagggaacccggtcccggtacccctttaaaccccgttccaacccttaacgttccccgtaccccaaacggtccccctttaccgaacgggttccgttacgggaaggtacgttacgggacgggtccgttacggtaaacgtttactttaacgtcgtacgacgggtaccgggttggggtacctacgggttcgggttcccgggtttgggttaacggttccgggacggggtacggaaacccgtacggtcgttaccggttacccggttcccgttaacgggacccgaaccgaccccggaggttccccgtcccggttcccccgttaacggg

SEQ ID NO: 315805 - DNA, 618 bp, Homo sapiens
  misc_feature: GZ8MTXP01ADU36.38.7.A07.1.454.CMB.2.raw
  modified_base (356)..(356): a, c, t, g, unknown or other
  misc_feature (356)..(356): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagacgggccctggtactgatgaagtcttaaatgtagatggccaccctacgaaccgaagggggacgacgggactcccgtagacctcgtcttcgtcgacggtccctcccgnggtccgtcgggtggggctgggacgtccgacctaccctccacctactcctaccgacgtccctccgtacgtcgtaggaggtagtcggacggtaccttaggtaaccgttattaacgtcggtacgtacgggtaccgggtcgggggtcctacggttcggtccgggtttggggtaaccgtcggggttacgggacggacgtaacggcgttacggacccgttccgtaacggtacgaaccgcccggtacgttcccgtcccgccccgtccgg

SEQ ID NO: 315806 - DNA, 776 bp, Homo sapiens
  misc_feature: GZ8MTXP01A5WFI.38.7.A07.1.454.CMB.2.raw
  modified_base (234)..(234): a, c, t, g, unknown or other
  misc_feature (234)..(234): n is a, c, g, or t
  modified_base (382)..(382): a, c, t, g, unknown or other
  misc_feature (382)..(382): n is a, c, g, or t
  modified_base (394)..(394): a, c, t, g, unknown or other
  misc_feature (394)..(394): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgccctcccgtgggacgccgtcggtcacgctcacctgcactctgagcgaggtggcacgagcagacaacgcatcgnagtgacatacaacatacgagaccgagacggacggtcctacggtatgatagaaagtacttaagtaggtacagtacgacctacccgtacgaacggaagggacgacggtactacccgtagtacctccgtacttcgacgacggtccctacgngtccgtccgggngggtactacggtacgcccgtacctaacctcccgaacctcgtccctacccgacgttccccgtaccgtagtccggtaggaaggtaactgggtaaccggtctaacgggtttaaaccttacgttaccgtagggtaacccggtcgggtaaccggggttcggggtacccgtttaacgggtttccggggttttaccgggggtttacggggtaaacgggtttccccgggggaaagggggtaacccgggttaaacccggtaaagggtttccccgtttaaacccgggggcccggtttaacccgggttaaccgggggtacccccaacccggggtaaccggggtaacccccgttcccgggttaacccccccggttcccccggttttaacccggg

SEQ ID NO: 315807 - DNA, 615 bp, Homo sapiens
  misc_feature: GZ8MTXP01CLP3L.38.7.A07.1.454.CMB.2.raw
  modified_base (576)..(576): a, c, t, g, unknown or other
  misc_feature (576)..(576): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtgggcacagcagcaacgccatcgcagtggacatacaacatcagccaagacggaacggccctaggtacttagatagaagtcttaaatagtgtagtcggaccacccgtacgaaccgaaaggggacgacggggtacctccccggtagtacgtccggtaccttaccgtacgaacggtccctacccgacgtcccgtcggtcgggggctcggacgccgtacctaccctcaccctactcctaccgacgccctacgacgtctagggacggtaggtacggtaggtacttacgtacttacgttacgtgtacgacggtacggtcgggactcggtcggttccgggttagggtacgttcggggacggacgggaccgngttcgtaacgaccgtcgacggtcacgtccgaacgtcccg

SEQ ID NO: 315808 - DNA, 592 bp, Homo sapiens
  misc_feature: GZ8MTXP01CBMWP.38.7.A07.1.454.CMB.2.raw
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctcgcctcccgtggggacgcctcggtcacgctcacctgcactctgagcaggtgggcacagcagcaacgcatcgcagtggcatacaacatacgacgaccgaaggaacggaacgggccccgttaggttacttagaagtagaaagtacttaaagtaggtgaacgtcgggaccaacccgtacgaaaccggaaaggggacgacgggtacctcccgtagtactccgtcttacacgcgcctacgacgtcgtcggtcggggctgcgcgactaccncacnctccncacgcctcgngtcgngaggagtcggagtctacgtacttagtacgtgtacgaggtcgggtcgggtctaggttcgggttcggtttgggtacggttcggggacggtacggacgagccgtcggtaccgtcgtacggtcgacgtccgaacggtcccg

SEQ ID NO: 315809 - DNA, 580 bp, Homo sapiens
  misc_feature: GZ8MTXP01B31DK.38.7.A07.1.454.CMB.2.raw
  modified_base (340)..(340): a, c, t, g, unknown or other
  misc_feature (340)..(340): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgagcttaatagtgatggccacccgtcaacgaaggggagacgggactcccgtgactcgtcttctccgnggctccgagctcgtggggctggacgcgctacctccaccatcctccacgtccctccgacgtctaggacgggagtggacggcttaggaaccttagttacgtcgtacgacgggtacgggtcgggggtcctaccggttcgggttcccgggtttggggtaacgttcggggaccggggtaacgggaccgttaggccgtaacggacccgttccgtacgggtccgaccggtaacccgaacggtccccg

SEQ ID NO: 315810 - DNA, 543 bp, Homo sapiens
  misc_feature: GZ8MTXP01A783V.38.7.A07.1.454.CMB.2.raw
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaatagtgatggccaccctcaaccgaagggagacgggatcccgtgacgtcgcttctcgacggtcctcccgngcgtcgtagggggctgagcgctaccctnacccatcctcagcctcagtctgagntgaggctgactntactgtcagcggtgggacncgtgtccggttgggtaacgttcgggcgggaaggcccgtaaaggtccgacgggttacccgttacccgttaagggtccgaacggaccccgaaggggcctcccggcccccgttccgg

SEQ ID NO: 315811 - DNA, 806 bp, Homo sapiens
  misc_feature: GZ8MTXP01DLY3D.38.7.A07.1.454.CMB.2.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagtcgatcacgtcacgaccggtgctcgatttagcacgtgtcgcagggggctggggagtcagcaccatggcttggaccccacctcctcttcctcaccctcctcctccactgcacagggtctctctcccagcttgtgctgactcaatcgccctctgcctctgcctcccgtgggagcctcggtcacgctccacctgcactctgagcagtgggcacagcagcaacgcatcgnatgacatcaanatcagnaagagaacgggccctggtactaggatacgaaagtactttaaagaggtgaagttcgggaaccctaacccccgttagaaaccccgggaaaaggggggacgtaaaccgggggtaaccgtcccccttagggtaacccttccggtctttaccgtacgaaccggggtacccttacccaagggtccgttacgggtcggggggcttacgggaacgggtccccgtacccttaacccctacctaaacccgtaccttcccttacccgaacccggtaccccttaaccccgtaaggtttacccggtagggaaacggtaaacggtgggtaacgggtacgttacgttaaactttaacgttaccgtacggttaccggaaagggtacccgggttagggggaccgtaaccgggtttccggggttaaccgggttttcgggggttaaacggttcgggggaaaccggggtaacggggaacctaaggtccggttacccggttaccggttacccgttaacgggggaccaacccggacccggtaacgggttccccgttaaccccgggttcccccgtttccggg

SEQ ID NO: 315812 - DNA, 672 bp, Homo sapiens
  misc_feature: GZ8MTXP01BZ37H.38.7.A07.1.454.CMB.2.raw
  modified_base (277)..(277): a, c, t, g, unknown or other
  misc_feature (277)..(277): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggacatcaacatcagccagagaacggcctaggtactgatgaatcttaanagtagatggacctaacccgtcgaaccggaagggacgaccgggtaactccccgtagtaaccgtccggtcttaccgtaccgacgggtccctacccgtaacggtcccgttcggggtcgggggtaccgttacggggaccggtaccccgggtaccctttaacccccgttaccgaaaccccgtaaccgtccccgtttaccccaaaccggggtcccccttacccgtaagttccggtacggaaggtacgtaggtacggtactagtaaccgttataacgttcgacgtacggacggttcggggactagtcggtaccgggtttgggtaacgtcggggttacggacggacgtaagcgttacgccggttcgaagtcaacgccgacgttccgtaaccgccccgttaacg

SEQ ID NO: 315813 - DNA, 559 bp, Homo sapiens
  misc_feature: GZ8MTXP01AWTB5.38.7.A07.1.454.CMB.2.raw
  modified_base (179)..(179): a, c, t, g, unknown or other
  misc_feature (179)..(179): n is a, c, g, or t
  modified_base (304)..(304): a, c, t, g, unknown or other
  misc_feature (304)..(304): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacncctcggtcacgctcacctgcactctgagcagtgggcacagcagcaacgccatcgcatggcatcaacatcagccagaggacggccctggtactgatgaagcttaaagtagtgatcggaccaccctnaaccgaagggagaccgggacctcccgtagacgtccgtcttccgacgcggcctcccgagccgttcggtcgggggctggacgtcgtcctaccaccaccactcctaccacgtccctccgacgttcgagtaggagtcggaggtctacgacttattcgtgtacgaggtacggtgggcgtacgtcggtccggtttgggtacgttcgggacgggacgggaccgagcgtaacggccgtcgtacggcacgtccgaacggtcccg

SEQ ID NO: 315814 - DNA, 765 bp, Homo sapiens
  misc_feature: GZ8MTXP01A76HV.38.7.A07.1.454.CMB.2.raw
  modified_base (243)..(244): a, c, t, g, unknown or other
  misc_feature (243)..(244): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcagtgggcacagcagacaacgcatcgcagtggacatcaanncagccagacgacggcctagtactgatagaagtacttaagtgtgacgtacggacctacccgtacgaaaccggtaaagggggacgtaacggggtaccttacccgtagtaccgttccgtacttaccgtacgaacgggtccctaccgcggtccgtcgggtcggggtactcgggaacgtcccgtacccttaccctaccgaaacctctcccgtacccgtaaccgtccccgtaccgtaacgttcggtaaggaacgggtacgtagggtaaaccgggttcttaacggttaaaccctttagtttaaacccggtgggttacccgaaggggttaacccggggttcggggtacccttaacggggtttccggggtttaacccggggttttcgggggtaaacggtttcccgggggaaacggggttaacccgggttaaaccgaacggggttccgttaaccgggttccccgttacgggtaaccggtacccgaacgggtaaccccgtcgggttcccttccccggaacccccgtttccgg

SEQ ID NO: 315815 - DNA, 671 bp, Homo sapiens
  misc_feature: GZ8MTXP01EYRM1.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatacaaacatacacgaccaaggacggaaacgggcccctacggtaacttgatagaagtacttaaagtagtagatacgggaccacccgtacaaccgaaagggggtacgaccggggtaacctccccgtaggactccgtcgttacctcgaacggtcctaccgaggtccgtcgggtcgggggctcggacgtcccgtactaccctcacctactcctaccacgtccctaccgagttccgtaggacggtaaggtcggtaacgggtccttaacgtaacgttacttacgtcgtaaccggagggtaccgggttacggggcctaggttcggggtccggtttgggggtaacgttccggggacggggaacgggttacccgaaggttcccgtaacgggacccgttccggtaacgggtccaccgggtaacccgttaacgggtccccg

SEQ ID NO: 315816 - DNA, 735 bp, Homo sapiens
  misc_feature: GZ8MTXP01BX4CA.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctccctgggacgcctcggtcacgctcacctgcactctgagcagtgggcacagcagcaacgcatcgcatggcatacaacatcagccaagacggaacgggtcccctagggtacttggataggaagtactttaaagtagtagaagtcgggaccaccccgtacgaaacccggaaggggaacggaccggggtaacccttccccgtaggtaactccggtcctttcccgtaccggaacgggtcccttacccgaagggtccccgtttcggggtacggggggtcttacggggaaccggtcccgggtaacccctttacccccgaccgtaaaccccctaaggtttccccctaccccgtaacgggtccccctttaccggaacgttcccgttagggaaccggggtagttacggggaacggggtcctacggtaacctttaagttaccgtcggttaacccgagggtaccggggtgggtcctacggttcgggtccgggtttaggggtacgttcgggggaccgggtagggacccaggttccggtaacgtcccggtaacgagggtcccacgtcccgaaggtcccg

SEQ ID NO: 315817 - DNA, 647 bp, Homo sapiens
  misc_feature: GZ8MTXP01A701K.38.7.A07.1.454.CMB.2.raw
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaaacgccaatcgcatggcatcaacatcagccagaggaacggccctggtactgatgaatcttaanagtgagtgacctacctacgaaccggaaggggacgacgggactcccgtagtacctcggtcttcgtacgacggtcctaccgngtcctcgggtagggctaggaccgtcgtaccctaccctcacccactcctacccgacgtacccgtcgtacgtccgtaggaggtacgtagggaacggcttacggtaacttacgttacgtgtacgtacggtacgggtcggggactcggtcggttccgggtttagggtaacggttcggggacgggaaccgggttaaccgtaacggtacccggttacgggcccggttaccggttaacgggccgaaccggtaccccggaacggttccccgttccccggttcccccggttccgg

SEQ ID NO: 315818 - DNA, 724 bp, Homo sapiens
  misc_feature: GZ8MTXP01EMNQU.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcagtgggcacagcagcaacgccatcgacagtggcatcaaacatcagccgaaggacggaacggccctggtacttgatagaatcttaagtagtgatcggccaccgtacgaaccggaagggacggaccggactccgtaggtactccggtctttaccgaccgtaacgggtccctaccgaacgggtccgtttacggggtcggggggtccttacggaaccggggtcccgtaccccgttaacccgtacccgtaaccccgtaacgtttacccctaccccgtaaccgggtccccttaccgtaccgttaccggtaagggtacgggtacggttacgggtaacggggtccttacgggtaaccttaacgtttacgtcggtaacgtaacgggtaccggggtcggggtacctaacgggttcgggttccgggttttaggggtacggttaccgggggacgggtaacgggttacgttacggacggttccgaccggttaacggttacggcgaccggtaacccgaacggtccccg

SEQ ID NO: 315819 - DNA, 709 bp, Homo sapiens
  misc_feature: GZ8MTXP01AP8SE.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtggcacagcagcaacgccatcgcatggcatcaaacatcacgccaggacggaaacgggcccctacgggttacttgaacgttaggaaacgtctttaaagtaggtgaacgtcgggacctaaccccgtacgaaaccgaaaggggacggaccggggtacctccccgtagactccggtcttccgtcgaacgggtccctacccgacggtccgttccgggtggggggtctacgggaccgtcccggtaccttaccccgtaccgaaccctaacgttcccctaccccgaacggtaccccttcccgtaacggttccggttagggaacgggtacggttacgggaaacggggttcctacggtaaccttaacgtttaaccgtcggtacgacgggtacgggtcggggtccgtacggtcgggttccggtttggggtacggttccgggacggggtaacgggttacgacggttcgtaacggacccgtcgtacgggtccgacgcccgaacggtccccg

SEQ ID NO: 315820 - DNA, 732 bp, Homo sapiens
  misc_feature: GZ8MTXP01ETE1P.38.7.A07.1.454.CMB.2.raw
  modified_base (174)..(174): a, c, t, g, unknown or other
  misc_feature (174)..(174): n is a, c, g, or t
  modified_base (242)..(243): a, c, t, g, unknown or other
  misc_feature (242)..(243): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctcccgtgggancctcggtcacgctcacctgcactctgagcaggtgggcacagcagacaacgcagtcgcatggcatcaannacagaccaggacgaacggccctaggtactgatagaagtacttaagtagtagagtcggaccacccgtacgaaacggaaggggacgacggactccgtagacctcgtcttcgtcgagtcctccgngtcgtcgggnggggctacggacgccgacccttaacccgtcaaccctactccctacccgacgtcccgtaccgtaggttccgtagggacggttagtacgggacgttaccgttaggttaacctttaattaccggttacgtccggtaacgggtaccggggttacgggggtaccttacggggtttccggggttacccggggttttgggggtaaaccggtttcccgggggaaacgggggtaaaccgggttaacccgtaaacgggttcccgggttaaccggttaccccgggtttacccggaaggggttaccccgaacccgggtaaccccggtacgggttccccggttaacccggttcccccccgtttaaccggg

SEQ ID NO: 315821 - DNA, 577 bp, Homo sapiens
  misc_feature: GZ8MTXP01EH7ST.38.7.A07.1.454.CMB.2.raw
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgccatcgcatggcatcaacatcagccagagaacggccctggtacttgatgaagtctaatagtgatggacacctacgaaccgaagggagacgggactcccgtgatcgtcttacncgaacggctccgagtctcgtcgggggctgacgcgctaccncaccatcctaccgacnccctacagtctaggacgtagtgacgggtctaggtaacttacgttacgtcgtacgtacggtacgggttcggggacctacggtcgtccgggtttagggtacggtttcgggacgggacggggaccgaacggttccgtaacggaacccggtccgtacggtacccgacggccccgttaacgggtccccg

SEQ ID NO: 315822 - DNA, 599 bp, Homo sapiens
  misc_feature: GZ8MTXP01ATETA.38.7.A07.1.454.CMB.2.raw
  modified_base (239)..(239): a, c, t, g, unknown or other
  misc_feature (239)..(239): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagcagagacggcctggtactgatgaagtcttaaagtgtgatcggacctaccccgtacaaccggaagggacgacgggactcccgtgacctcggacttcncgaggcctcgngtctcggnggggctagcgtcgacctacctcacctagtcctaccacgtccctcgagtcgtggagataggacggctaggtaaccttagttacgtcggtcgaacggtaccgggtcggggacctacggttcgggtcccgggttttgggggtaacttccgggggacggggaacggaccgtaaacggtccgttaccggttcccgttaccgtaaggccaaccgacccgacgggttcctcccgggcccccgttcggg

SEQ ID NO: 315823 - DNA, 597 bp, Homo sapiens
  misc_feature: GZ8MTXP01C1Y34.38.7.A07.1.454.CMB.2.raw
  modified_base (369)..(369): a, c, t, g, unknown or other
  misc_feature (369)..(369): n is a, c, g, or t
  modified_base (441)..(441): a, c, t, g, unknown or other
  misc_feature (441)..(441): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggacatcaacatcagccagagaacggccctggtacttgatgaaagtcttaaataggtgagttcggacctaccccgtagaacccggaaagggggacgaccgggactcccgtagtacctcggtacttgtcgacggcctccgngtcctcggtgggggctggacgcgtacctaccctcaccctatcctaccacgtcctccgagttccgaggaaggntaggacgggtcttacggaactttaacgttaacgcgttacgacgggtacggttacggggctacgttcggtccggtttgggtaacgtcgggagggtacggacgtaagcgttacgccgttacgtaagggctcgacccgaggttcctccgccccgttcgg

SEQ ID NO: 315824 - DNA, 616 bp, Homo sapiens
  misc_feature: GZ8MTXP01BJAL6.38.7.A07.1.454.CMB.2.raw
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgcatcgcagtggcatcaacntcagccagagacggccctggtactgatgaagtcttaaagngtgatcggaccacccgtacgaaccgaaggggacgacggtatcccgtgacctcgtcttctcgacggtcctccgngtctcggtggggctagacgccgtacctacctcacctactcctaccacgtccctcgtagtcgtaggacgagttaggacggtcgttacggtaacttacgttacgtcggtcgaacgggtacgggtacggggtctacggttcggttcccgggtttgggtaacggttcggggacgggtaacgggaccgaaacggtccgttacggttacccgttccggtaacggtccgaaccggcccggaacggttcccgtcccgttccccgttccgg

SEQ ID NO: 315825 - DNA, 563 bp, Homo sapiens
  misc_feature: GZ8MTXP01DL6D0.38.7.A07.1.454.CMB.2.raw
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaaagcttaatgtgatggaccacccgtcaaccgaagggagacgggatccgtgactccggcttcncgaggctcngctcgtggggctgacgcgctacctcaccactcctccacgcctccagtcgtggacgatgacggtctacggtacttaattacgtgtcgaggtacggtcggggctacgtcggtccggtttggggtaacgttcgggacgggtacgggaccgtaaggtccgttacggttccggttaccgttaagggaccaacggtcccgaacgggttcctccggcccccgttaacgg

SEQ ID NO: 315826 - DNA, 544 bp, Homo sapiens
  misc_feature: GZ8MTXP01DRUZH.38.7.A07.1.454.CMB.2.raw
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtggcacagcagcaacgcatcgcatggcatcaacatcagcagagaaacgggccctggtacttgatagaagcttaaagtagtgatcggaccaccctacaaccgaagggacgacggactccctgacgtcgtcttcacnggctcgagctcgtggggctgacgcgctaccgcacntcctcacgcctcacgtcaggacggagtggacgggtctacggtacttaagttcgtaggtccgtaggtacgggtgggacgtacgttcggtcgggttgggttacgttcgggacgggacggacgttacgcgtcgtaccgtcgtacgtcgacgtccgaacggtcccg

SEQ ID NO: 315827 - DNA, 714 bp, Homo sapiens
  misc_feature: GZ8MTXP01CUFNA.38.7.A07.1.454.CMB.2.raw
  modified_base (180)..(180): a, c, t, g, unknown or other
  misc_feature (180)..(180): n is a, c, g, or t
  modified_base (204)..(204): a, c, t, g, unknown or other
  misc_feature (204)..(204): n is a, c, g, or t
  modified_base (444)..(444): a, c, t, g, unknown or other
  misc_feature (444)..(444): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacncctcggtcacgctcacctgcactntgagcaggtgggcaacagcagcaacgccatccgcagtggacatacaacatacacgaccgaaggaacgggaacgggtccccgtacggttaacgttagataaggaaagtactttaaagtagtagagtccgggaaccacccgttacgaaaccggaaagggggacggtaaccggggtacctcccggtagtacgtccggtctttaccgacgaacggtcctaccgacggtcgtcgggtcggggtcncggacgtcccgaccttaccctccaaccgtaaccctcgtaccccgacgtcccgtaccgtacgtccgtaaggacgggtacggtacgggtaacggtcctacggttaaccttaaacgttccgttacggtaccgtacgggtaccgggtcggggaccgttacgggttcgggttaccggggttttagggtacgggttaccggggacgggtaacgggttacgttacgttccgggtaacgttaccggtcgttacggcaaccggtccgaacgggtccccg

SEQ ID NO: 315828 - DNA, 766 bp, Homo sapiens
  misc_feature: GZ8MTXP01BQZJS.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccaagagaacggccctaggtactgatagaagtcttaaagtagtgagtcgggaccacccgtacgaaccgaaaggggacggaaccggggtacctccccgtagaactccggtcctttaccgtaccgaacgggccttacccgaacggtccgttccgggtacggggggccttacgggaaccggtcccggtacccttaaccccgtacccgtaacccctaacgttccccttaccccgaaccggtcccctacccgtacggttaccgtagggtaacgggtacggttcgggaacggggttaccttacgggttaaaccttaacgtttaaccgttcggttaaccggtaacgggtaccgggggttacgggggtacccgttaacgggttcgggtttcccggggttttagggggttaacggtttcccgggggacggggtaaccggggttaccgttaaacgggttccggttaaccgggtaccccggttccggttaacgggtaccgaaccggtaaccccggaacgggtcccccgg

SEQ ID NO: 315829 - DNA, 572 bp, Homo sapiens
  misc_feature: GZ8MTXP01A9I2T.38.7.A07.1.454.CMB.2.raw
  modified_base (346)..(346): a, c, t, g, unknown or other
  misc_feature (346)..(346): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacatcagccagagaacggccctggtactgatgaagcttaaatagtgagtcggaccaccctacgaaccgaaaggggacgacgggactcccgtagactcgtctctacnggctccgagtctcgtcggggctgacgcgcctacctcaccatcctaccgacgtccctacgacgtctagaggtacgtgacggtctagtaacttagttacgtgtacgaggtacggtcgggctacggtcggtcgggtttaggggtacgttcggggacgggtaacgggttaccgaaggttccgtcggaccccggttcgtacgggtaccgaccggtcccgaacgggtccccg

SEQ ID NO: 315830 - DNA, 549 bp, Homo sapiens
  misc_feature: GZ8MTXP01CDDHI.38.7.A07.1.454.CMB.2.raw
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggcctggtactgatgaagcttaatagtgagtcggccaccctacgaaccgaaaggggacgacgggtactcccgtagactcgcttctcaggctcgngctcgtggggctggacgcgctacctcaccatcctccacgtccctcgagtctggacgactgacggtcgtacgtacttattacgtgaccgtaggacggtcggggctacggtggtccggtttgggtaacgttcgggcgggtacggaccgaagtcgttacggaccgttcgtaaggtcgcgacccgtagggcctcccggccccgtcgg

SEQ ID NO: 315831 - DNA, 683 bp, Homo sapiens
  misc_feature: GZ8MTXP01CFI9W.38.7.A07.1.454.CMB.2.raw
  modified_base (240)..(240): a, c, t, g, unknown or other
  misc_feature (240)..(240): n is a, c, g, or t
  modified_base (638)..(638): a, c, t, g, unknown or other
  misc_feature (638)..(638): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcagtgggcacagcagcacgcatcgcatggcatcaacntcagcaggagaacggccctcggtactgatagaagtcttaagagtgagttcggaccaccccgtacgaaccggaagggggacgaacgggtactccccgtaggtaacctccggtactttccgtactacggggcccttacccgaacggtccgttcgggtacgggggtcttacgggacggtcccgtacccttaaccctcaacctacgtccctacccgacgtccctaccgagttccgtaggacggtaatgggacggtcctgtaaccttagttaccgtggtacgtacggtacggggttacgggcttacggttcgggttcccgggtttaggggtaacgttccgggggacggtacggggacccgtaaggtcccggttacggttacccggttggttaaccgggacccnccgggtaccccggtagggttccccgtccccgggccccgtttccgg

SEQ ID NO: 315832 - DNA, 609 bp, Homo sapiens
  misc_feature: GZ8MTXP01DUVLG.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatacaacatcagccaagaggaacggccctaggtacttagatgaagtcttaaagtagtgagtcggaccacccgtacgaccgaaggggacgaccgggtactcccgtagactccgtccgttaccacgaacggtcctacccgacgtccgtcggtcgggggtctcggacgccgtacctaccctaccaccactcctaccacgtccctcgacgtcgtaggaggagtggagtcgtacgtacttagttctggtacgtacgggtacggtcgggtccgtacggttgggtccggtttggggtacggttccggggacggggtacgggttaaccgttacggcgtccggaccggtcgtacggtcgacgtaacccggaacggtccccg

SEQ ID NO: 315833 - DNA, 621 bp, Homo sapiens
  misc_feature: GZ8MTXP01D2FUV.38.7.A07.1.454.CMB.2.raw
  modified_base (217)..(217): a, c, t, g, unknown or other
  misc_feature (217)..(217): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctccctgggagcctcggtcacgctcacctgcactctgagcaggtggcanagcagcaacgccatcgcagtggcatacaacatcagccaaggagaacggccctggtacttgatgaagtcttaaagtagtgatcgggaccaccgtacgaaccgaaggggacgacgggtactcccgtagtactcgtcttcgtcaacggtcctaccgagtctcgggtggggtctggtacgccgtcctaacctccacctattcccgtccacgtccctacgtacgttctagggacggtagtggtacggtacttacgtaacttacttacgtgtacgacggtacgggtcggggtacctacggttcgggttccgggtttttgggggttccggacggggtaaacgggaacttaaacggttcggaaccccggttcgtaaggtccgaccggtccgacggtcccttcccggtccccg

SEQ ID NO: 315834 - DNA, 616 bp, Homo sapiens
  misc_feature: GZ8MTXP01ENTHL.38.7.A07.1.454.CMB.2.raw
  modified_base (152)..(152): a, c, t, g, unknown or other
  misc_feature (152)..(152): n is a, c, g, or t
  modified_base (172)..(172): a, c, t, g, unknown or other
  misc_feature (172)..(172): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctntgcctctgcctccctgggancctcggtcacgctcacctgcactctgagcaggtggcacgagcagcaacgccagtcgcatggacatacaacnacacgacgaaggacggtacggcctaggtatgatagaatntaagngtnacgtcgaccaccgtacgaacggagggacgacgtactccgagcctcgtctcgacgcgacctcgcgtcgtcgggtcgggactcgacgcctacctacctaccacctactccgtaccgtacgtacccgtacggtacgtcgaggacgtagtacggtacgtacggttaacgttaacgttacgttacgtgtacggacggtacgggtacggaccttcggttacgggttcgggttggtaacggtcggggaacgggaacgttaaccgtcggtccgttacggttccgttacgtaaccggacgaaccggtaccgtaccggttccgttccccgcccgtg

SEQ ID NO: 315835 - DNA, 670 bp, Homo sapiens
  misc_feature: GZ8MTXP01CZG95.38.7.A07.1.454.CMB.2.raw
  modified_base (173)..(173): a, c, t, g, unknown or other
  misc_feature (173)..(173): n is a, c, g, or t
  modified_base (411)..(411): a, c, t, g, unknown or other
  misc_feature (411)..(411): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctccagcttgtgctgactcaatcgcctctcgcctctcgcctccgtgggacnccgtcggtcacgctcacctgcactctgagcgaggtcgggacacgagacacgacaacgccagtcgacagtcgacatacaaactacacgaacgaccgaaggaacggaccgggtccctacgggttaactggaacgtaggtaaacgtacgttaaagtaggtacgaacgtcggaccctaaccgtacgaaacggaaggggacgaacggtactccgtagtacctcgtcttcgacgacgtcctcgngtcgtcgggtcgggctacggacgtcctaccctaccactacctactccgtaccgctacccgtcgtagtcgaggagattacgggacgtatacgtaactttacgtacgacggttaccgagggtaccgggtcgggtactacggggttcggttccgggtttaggggaaccggtcggggacggtaacgggaacgtacggtccgttacggttccgttacggtaaggcccgaacggtccggacgttccgtcccgttcccggttaacg

SEQ ID NO: 315836 - DNA, 625 bp, Homo sapiens
  misc_feature: GZ8MTXP01AH31H.38.7.A07.1.454.CMB.2.raw
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtgggcacagcagcaacgccatcgcatggcatcaacntcagccaaggacgacggcctaggtactgatagaatcttaagtgtgactcggaccaccgtagaacgaaggggacgacgggtactccgtagtactcggtacttcgtacgacggtcctacncggcgtcgggtcggggctggacgccgtacctacctccacctactccgtaccnctcccgtacacgttcgaggacgtacgtagggtacggtcttacggtaactttagtacgtcggtacgagggaccggttcgggggaccttcggttcgggttacgggtttggggtaacgttcgggggaacgggtacggacgtaacggtcggttacggttaccgttcggttaacgggccaaccgggaaccgtcggttccgtcccggttcccgtccgg

SEQ ID NO: 315837 - DNA, 720 bp, Homo sapiens
  misc_feature: GZ8MTXP01AT9JU.38.7.A07.1.454.CMB.2.raw
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
tcagtcgatcacgtcacgaccggtgctcgatttagcacgtgtcgcaggggagagctctggggagtcagcaccatggcttggaccccactcctcttcctcacccctcctcctccactgcacagggtctctctcccagcttgtgctgactcaatcgccctctgcctctgcctccctgggacncctcggtcacgctcacctgccactctgagcagtgggcaanagcagcaacgccatccgnatggcatacaacatcagccagacgaacggccctggtactgatgaaagtcttaatagtgatcggaccaaccctacgaaccgaagggacggacgggtacctcccgtggactcgtcttactcgaacgggtcctcccgagccgttcggtcgggggtccttagggacgtccgtacccttaaccccgtaccaaccctacgtaccccgtacccgtaccgtaccccgtaccgtacgttaccggtaggtacggacggttaacgggtacggttaccgttaacggttaaccgttaacgttaccgttacggtaaccggacgggtaccgggtacggggtaccgtaccgggttccgggttaccggggtttacggggtacggttaccgggggtaacggggtaaccggggttaaccgttaacgggttcccggttaaccgggtaacccgttaaccgttaaccggtaccggaccggtaaccccggttaaccgggtccccg

SEQ ID NO: 315838 - DNA, 699 bp, Homo sapiens
  misc_feature: GZ8MTXP01D9AAD.38.7.A07.1.454.CMB.2.raw
  modified_base (173)..(173): a, c, t, g, unknown or other
  misc_feature (173)..(173): n is a, c, g, or t
  modified_base (243)..(243): a, c, t, g, unknown or other
  misc_feature (243)..(243): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggancctcggtcacgctcacctgcactctgagcagtgggcacgagcagcaacgccatcgcatcggcatcaaacntacagaccagacgacgggcctggtactgatgaagtcttaatagtcgagtggaccacccgtacgaaccggaagggacgacgggactcccgtagacctccggtacttcgacgacggtccctacgcggtccgtcgggtcggggctacgggacgtccgtaccttacccacctaacctactccgtaccctaacgtccccgttacgtacgtcgtaggaacggtacgttaagggacggttacgttaacggtaactttaaacgtttacgtacggtaccggtaacgggtaccggggtacggggtaccgtacgggtttccgggttccgggttttaggggtaaccgggtttaccggggacggggaaaccggggttaccgaaacggtccggttaccggttccggttaccgtaacgggtaccaaccgggtacccggaacggttcccgtaacccggttccccgtttccgg

SEQ ID NO: 315839 - DNA, 646 bp, Homo sapiens
  misc_feature: GZ8MTXP01D6YLD.38.7.A07.1.454.CMB.2.raw
  modified_base (152)..(152): a, c, t, g, unknown or other
  misc_feature (152)..(152): n is a, c, g, or t
  modified_base (174)..(174): a, c, t, g, unknown or other
  misc_feature (174)..(174): n is a, c, g, or t
  modified_base (244)..(244): a, c, t, g, unknown or other
  misc_feature (244)..(244): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctntgcctctgcctcccgtgggacncctcggtcacgctcacctgcactctgagcaggtggcacgagcagcaacgccagtcgcagtgacatcaacntcagccaggacgaacggccctaggtacttagatagaaagtcttaaagtagtgaatcggaccaacccgtacgaaacggaagggggacgaccgggtactcccgtagtaccctccggtacttccgacgacggccctccgaaggtccgtcgggtcggggctagggaccgtccgtacctaccctacaacctacttccgaccacgtacccctacgtagttcgaggaagtgtagtacggtctagtactttaagtcgtgtacggaaggtcgggtgggtcctaggttcggttaccgggtttggggtaacgtcccggggaaggggtaccggaaccgtaacggtcggttacggacccgttcggtaacgggtccaaccgggtaccgacgggttccctaacccggttccccgtcg

SEQ ID NO: 315840 - DNA, 746 bp, Homo sapiens
  misc_feature: GZ8MTXP01BZETU.38.7.A07.1.454.CMB.2.raw
tcagtcgatcacgtcacgaccggtgctcgatttagcacgtgtcgcagggggagagctctgggggagtcagcaccatggcttggaccccactcctcttcctcaccctcctcctccactgcacagggtctctctcccagcttgtgctgactcaatccgccctctcgcctctcgccctcccgtggggacgcctcggtcacgctcacctgcactctgagcaggtcggcaacgagcagaccaaacgccagtcgcagtggacaatacaaacatcgagaccaaaggaacggaaccgggtccccttagggttacttagagttacggaaagtacttaaaagtagtgtagtccggacctaaccccgtacgaaaccggaaaagggggacggtaaccggggtaacccttccccggtagtaacgtcccgtacgtttaaccaccgaacggtccttaccgaggtccgtacgggtcgggggactcggacggtcccgtaccgtaacctaccaaccgtaattccccgtaccaaccggtccccttacacgtccgtaaggagggtacgtacggtacggtactacggtaaaccttaattaccggtacgttacggaaggtccggggtggaccgtacggtcggggtttaccggtttagggggtacgttccgggggaggggtaacccgggttaaacgttaccggttcggttaaccgggacccgttccggtaacggggtacccaaccgggtaaccccgaacggggtccccg

SEQ ID NO: 315841 - DNA, 763 bp, Homo sapiens
  misc_feature: GZ8MTXP01BZM02.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagacaacgcatcgcagtggcatcaaacactcagccgaaggacggaacgggtcccctacggttactagagtagaacgtacgttaaataggtgacgtcgggaccctacccgtacgaaccggaaaggggacgacggggtacctcccgtagtactccggtctttaccacgtcggtcctacccgtagtcccgttcgggtcgggggtcgtacggaccgtcccggtacccttaacccgtacctacccttaacgttccccgtaccgaccgttcccctaccgtaacgttccggtagggaacgggtagttacgggtacggtcttaacggtaaccttaacgttacggttacggtaccgtaacgggtaaccgggttcgggggtaccttaacggtttcggggttcccggggtttttagggggtaaaccggtttccgggggaacgggtaaccggggttaaacccggttaacgggttcccggttaaccgggtaaccccggttcccgggttaacgggtacccgttaccggggtaaccccgttaaccgggttcccccggg

SEQ ID NO: 315842 - DNA, 710 bp, Homo sapiens
  misc_feature: GZ8MTXP01BS881.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgcatcgcatggcatcaaacatcagccaagagaacggccctaggtacttgataggaagcttaaatagtgatcggaccaccctacgaaccgaaaggggacgacggggtacctccccgtagacgtccgtcttaccgtacgcgggtccctacccgaacggtcccgttccggtcggggggtccttagggaaccgggtcccggtccgttaaaccccgttcccgaaaccccgtaacgttccccttaccccgaaacggtcccccttcccgaaacggttcccgttagggaacgggtacggtagggtaacgggtccgttaacgtaaaccgttaactttaaccgtaggttaaccgacggtacggggtacgggggtcctaaccggttcgggttcccgggttttagggggtacgttccgggggtaacggggtaacgggaaccgttacggcgttaacggacccgtaacgtacgggtacgacgtcccgaaaggtccccg

SEQ ID NO: 315843 - DNA, 651 bp, Homo sapiens
  misc_feature: GZ8MTXP01ARYFO.38.7.A07.1.454.CMB.2.raw
  modified_base (290)..(290): a, c, t, g, unknown or other
  misc_feature (290)..(290): n is a, c, g, or t
  modified_base (365)..(365): a, c, t, g, unknown or other
  misc_feature (365)..(365): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagacggaacggccctcggtacttgataggaatcttaataggtanagtcggaccaccctacgaaccggaagggacgacgggactcccgtagacctcggtacttcgtacgacggctaccgngtcctcggtcggggctggacgccgtcctaacccgtcaaccctacgtcctacccgagtcccctcgtaggtcctaggacgtatcggaacggtctagtaaccttagttacgtgtacgaaggcggtgggacctaggttgggttcccgggtttagggggtcgttcggggacgggggtaccggttaaaccgtaaacggtccggttacgggttaaccccggttcgttaacggggtcccctaacccgggaccccgtaacggggttccccgttccccggttcccccggttcccgg

SEQ ID NO: 315844 - DNA, 645 bp, Homo sapiens
  misc_feature: GZ8MTXP01D22QA.38.7.A07.1.454.CMB.2.raw
  modified_base (246)..(246): a, c, t, g, unknown or other
  misc_feature (246)..(246): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtggggagccctcggtcacgctcacctgcactctgagcagtggcacagcagcaacgcatcgcagtggacatacaaacgntcagccaaggacggaacggcccctggtactgaatgaaagtctttaaagtaggtgaacgtcggaccctaaccccgtacgaaaacccggaagggggganaaccgggtactccccgtaggtaacctccggtcttcacgacgcccttaccnggtctcggtaggggccagacggtctaccctacctacacctactcctaccgacgtcctctaacgttcgaggagtagtagacggtacgtagttaaccgttattaccgtagtaccgagggtacggtcgggggtctaacggttcggttccgggtttgggtaacggtttcgggacgggaacgggaacgtaacgggtcgttaccggccgttacggtaacgaccgaaccgccgacggttcccgtccggccccgttccgg

SEQ ID NO: 315845 - DNA, 791 bp, Homo sapiens
  misc_feature: GZ8MTXP01EB9AV.38.7.A07.1.454.CMB.2.raw
  modified_base (236)..(237): a, c, t, g, unknown or other
  misc_feature (236)..(237): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatgcatcaanncagcagagacggcctggtactgatgaagtcttaagtagtgatcggactaaccccgtacgaaccgaaagggggagaaccgggtacttccccgtagtaacccgtcccggtcgtttacgtacccgtacggtcccttacccgaacgggtcccgttccgggttacgggggccttacggggaaccgggcccgtaccccgttaaccccgtacccgtaacccctaaccgttccctacccgaacccggttcccctacccgtaacggttcccgtacggaacgggtagttacgggtacgggttaccggtacggttaaccgtttaacgtttaccgttacggttaccgaacgggtaaccggggtcgggggtaccggttaccggttacggggtttccggggttttcgggggtaacgggtttaccgggggaccgggggtaaccggggttaaacccggtaacgggtcccggttaccgggttacccggttacccgttaacggggttacccgaagggtacccccccccccggtaagggttccccgtcccggttccccccgggtttccccggg

SEQ ID NO: 315846 - DNA, 658 bp, Homo sapiens
  misc_feature: GZ8MTXP01BZTY7.38.7.A07.1.454.CMB.2.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctccagcttgtgctgactcaatcgccctctgcctctcgcctcccgtgggagcctcggtcacgctcacctgcactctgagcagtgggcacagcagcaacgcatcgcatgcatcaanacncagacgagacgacggtcctggtatagatagtaacgtattaagngtanacgtacgacctaccgagaacggaagggacgacgactccgtagccgtccgtcttcgacgacgtcctacgngtcgtcgggcggtctacgacgccacctaccncactacctcaccgcgtacctacgtacgtcgtacgagtagtacgtacgtacggtacgtaacgttaacgttacgttacgtacggtacgggtacgggtacgggtaccggtacggttacgggttaccggggttacggggttaacgggttaccggggttaccggggtaacgggttaaccggtaacggtaccggttaccgggttaccggttacccggtaaccggtaccggtaacccggtacccggtaccggttacccgtcccggttccccggtcccg

SEQ ID NO: 315847 - DNA, 657 bp, Homo sapiens
  misc_feature: GZ8MTXP01B28CE.38.7.A07.1.454.CMB.2.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (361)..(361): a, c, t, g, unknown or other
  misc_feature (361)..(361): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctccagcttgtgctgactcaatcgcctntgcctctgcctcccgtggggacncctcggtcacgctcacctgcactctgagcaggtggcacngcagcaacgcatcgcatggcatacaacatcacgaccagaacggacggtccctcggtacttgactagaagtacttaagtagtgagtcggccaccgtacgaaccggaaaggggacgacgggtacctccgtgtacgtccgtcttcncgaacggtcctccgaggtccgtcgggtcgggggctacggacgtcgtacctaccgtccaaccgtactccctaccgacgtacccctaccgtaggtccgtagggaacggtcgggtacggaacgggttctaacggtacttaacgtcgtacggtacgtacggtaccgggtcgggtacttggttcgggttcgggtttacgggtcgggttccggggacggggtaacgggttaaccgcggttacccggtaacggtaccgttccgggtaacgggtccggaccgtccgggttaacccggttcccgg

SEQ ID NO: 315848 - DNA, 602 bp, Homo sapiens
  misc_feature: GZ8MTXP01C3D00.38.7.A07.1.454.CMB.2.raw
  modified_base (152)..(152): a, c, t, g, unknown or other
  misc_feature (152)..(152): n is a, c, g, or t
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctntgcctctgccctccctgggancctcggtcacgctcacctgcactctgagcaggtggcacagcagcaacgcatcgcatggacatcaacntcagccagaggacggcctggtactgatgaancttaanagtgatcggacctacccgtagaaccgaaggggagacgggactccgtagactccgtacttctacgacggtcctaccgnggtcctcgggtacggggctcgggacgtccgtacctacctcacctactcctaccgacgccgtaccgtagtcctaggacgtagtaggacgtcgttatacgttattaccgagtccgaggtacggtcgggactacgttcggtcggtttgggaacgttcggggacgggtaacggacgtaacggtcgttaacgttcccgttaccgtaaggacccgaacgggtacccgacgggttccctcccgttccccggttcg

SEQ ID NO: 315849 - DNA, 701 bp, Homo sapiens
  misc_feature: GZ8MTXP01D9FGN.38.7.A07.1.454.CMB.2.raw
  modified_base (248)..(248): a, c, t, g, unknown or other
  misc_feature (248)..(248): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctcgcctccctgggagcctcggtcacgctcacctgcactctgagcaggtgggcacagcagcaacgcatcgcatggcatcaacancagccaaggaggaacggccctggtacttagagtagaagtcttaaagtgtagatcggacctacccgtacgaaaccggaaaggggacggaacgggtacctcccgtagtacgtccgtcctttaccgacgtaacgggtccttacccgaacggtcccgttacgggtcggggggcttacgggaaccggtccgtacccttacccgtaccaaccgtaacttcccgttaccgaccgtaccctaccgtacgtccgttaggacgggtacgtaggacggtacttacggtaacttaacgttcgtgtacggacgtacggggtcggggtacctaacggttcggttccggggtttagggtaacgggtttccggggaacggggtaacggggaacccgttagggttaccgttccggggtaccggttccggttacgggtacccgaccggttccccggaaccggggttccccg

SEQ ID NO: 315850 - DNA, 746 bp, Homo sapiens
  misc_feature: GZ8MTXP01D3DTF.38.7.A07.1.454.CMB.2.raw
  modified_base (173)..(173): a, c, t, g, unknown or other
  misc_feature (173)..(173): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggancctcggtcacgctcacctgcactctgagcaggtggcacagcagcaacgccagtcganagtgacatacatnacacgacgaggtaacggaccgtcccgttaggtactagactaggaatacttaagtagtgacgtcgaccctacccgacgaaacggtagggacgaccggactccgagtaccgtccgtcgttcgaccgtaccggtccctacgcggtcgtccggggacgggtcagggaccgtccgttaccctaccacctaaccgtctcccgtacgaccgttacccctaacgttcgtggaagggaacgtcgtaacgggtaccgtacgtttaaacggttaacctttacgtacgtacccgggtaggtaacggggttccgggggttaccggtaacccgttcggggtttcccggggtttacgggtttaaccgggggttcggggacgggggaacccgggtaacggttaaccggttaaccggttccggttaacccgggttcccggttacggtaacccggtaccccggtaaccgacccgggggttacccttccccggtttaaccccccgttcccggtttaacccgg

SEQ ID NO: 315851 - DNA, 739 bp, Homo sapiens
  misc_feature: GZ8MTXP01ASIIA.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctcgcctcccgtgggacgcctcggtcacgctcacctgcactctgagcaggtgggcacagcagccaacgccatcgacagtcggacatacaaacactacacgccgaaggaacggaacgggtccccgtaggttactagaataggaatacgttaaagtaggtacgagtcggcccacctacgaaccggtaagggacgacgggtacctccgtagactccgtacttccgacgaacggtcctaccgagtccgtcggtcgggggctggaccgtcgtaccctacccgtcaaccctacgtccctaccgaccgtccccgtaccgtacggttcgtacgggaacgggtaacgtggtacgggtacgttacggtaaacctttaagttaccgttaggttaaccgaacgggttacggggtaccggggtaccttaacgggttccggggtttaccgggttttacgggggtaccggttccgggggaaacggggacccggggttaacgttacgggttacccggtttaaccggggaccccggttttaaccggacggggttacccgaacccggaacccggttaacgggttcccccccgg

SEQ ID NO: 315852 - DNA, 627 bp, Homo sapiens
  misc_feature: GZ8MTXP01ARRNC.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggagcctcggtcacgctcacctgcactctgagcaggtggcacagcagcaacgcatcgcagtggacatcaacatcagccagagacggccctggtactgatgaaagtcttaagtagtgatcggacctaccctacgaaccggaagggacgacgggactcccgtagtacctccggtcttacgtcgacggtcccttaccgcggtccgttcgggtacgggggcttacggacggtacccgtaccctaccctccaaccctactccctacccgacgtacccctaccgtaagtccgtaggacgagttcggaacggtctagtacttattacgtgcgaggcgggtggactcggtcggtccgggtttggggtaacgtcggggacggggtacggacgtaacggtcgacggttccggttaccgtaaggaccgaacgacccggacggttcccgtcccgttcccccgttaacgg

SEQ ID NO: 315853 - DNA, 765 bp, Homo sapiens
  misc_feature: GZ8MTXP01EY3CU.38.7.A07.1.454.CMB.2.raw
  modified_base (178)..(178): a, c, t, g, unknown or other
  misc_feature (178)..(178): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgccatcgcatggcatacaacatcagccaggaggaacgggccctcggtactgatgaagcttaagtagtgatcggcctaccgtcgaaccgaagggacgacgggacctcccgtgactcggtcttactcgaacggtcctaccgagtccgtcgggtcggggggtcttacgggaaccggtcccggtaccccgtttaaccccgtaccgtaaccccgtaacgtttcccctaccccgtaaccggtcccccttaccccgtaacggttccgttacggggaagggtacgggttacgggaaacggggtccgtttaacgggttaaacctttaaccgtttaaccgttacgggtttaccggaacgggttaaccggggttcgggggacccgttaaccggtttccggggtttaccggggtttttacgggggtaccggttttccgggggaacgggggtaaccggggaacccgttaaggggccccgttaacccgggtacccgggttaacccggtttacgggacccggttaaccgggtccccggttaaacggggtcccccgg

SEQ ID NO: 315854 - DNA, 701 bp, Homo sapiens
  misc_feature: GZ8MTXP01B1PS1.38.7.A07.1.454.CMB.2.raw
  modified_base (442)..(442): a, c, t, g, unknown or other
  misc_feature (442)..(442): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctcgccctcccgtgggacgcctcggtcacgctcacctgcactctgagcaggtcgggacacgagcgacgaccaaaccgccaagtccgacagtcggacaataccaaactacacgacgaccgaaggaacggtaaccgggtccccgttacgggtacttaggaagttaggaaagttacttaaagtaggtagaacgtcggaccctacccgtacgaaaccggaaggggtacgaccgggtactcccgtagacctccggtacttcgtacgacggtccctacgcgtcgtcgggngggtctacggaccggctaccctacctccaacctctccctacgacgtcccttacgaagttccgaggacgagttagggacgtctaacggtaactttacgtacggacgtacgacggggttacggtcgggtaacctcgggttacgggttccgggtttaggggtaaccggtcggggaacggtacggaccgtaacggttcgttaccgggaccgttcggtaacggccgaaccgcccgggtagttccctcccggttccccgttaacg

SEQ ID NO: 315855 - DNA, 676 bp, Homo sapiens
  misc_feature: GZ8MTXP01E1KVR.38.7.A07.1.454.CMB.2.raw
  modified_base (251)..(251): a, c, t, g, unknown or other
  misc_feature (251)..(251): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtgggcacagcagcaacgccatcgcagtggcatacaacntacagaccaaggaggaacggtccccgtcggtacttgagtagaagtacttaagtagtagagtcggaccacccgtacgaaccgaaggggacgacgggtacctcccgtagactcgtcttaccgtcgaacggcctccgagtccgtcggcgggggtctacggacgtccgtaccctaccgtaccaacccgtactccccgtaccgtaaccggtccccttaccgtacggttaccgtagggaacgggtagggtacgggtaacgggtacttacgggtaaccttaacgttacgttacggtacggtacgggtacgggtcgggacctacgggttcgggttccgggtttaggggtacggttcgggacggggtaacgggaccgttaaggttccgtaacgggacccgttcggacggtacgaccggtcccgaacggtccccg

SEQ ID NO: 315856 - DNA, 667 bp, Homo sapiens
  misc_feature: GZ8MTXP01DZO3U.38.7.A07.1.454.CMB.2.raw
  modified_base (225)..(225): a, c, t, g, unknown or other
  misc_feature (225)..(225): n is a, c, g, or t
  modified_base (380)..(380): a, c, t, g, unknown or other
  misc_feature (380)..(380): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgccctccgtgggagccctcggtcacgctcacctgcactctgagcgaggtgggcacagcagcaacncatcgcagtggcatcaacatcagccaggaggaacggcctaggtacttgatagaagtacttaagtagtgacgtcggacctaccctacgaaccggaagggggacgaccgggtactcccgtagtaccgttccgtacttcgtaccgacggtccctccgnggtccgtcggggtcggggtcctacggacggtcccgtacccttacccgaccaccctacgttcccacccgaccgttaccccttaccgtaggtttccggagggtaaacggtcttagggaacggtcttaacggttaaccttttagtaccgtacggtaacgtaggtaccggggtgggaacccttgggttccgggttaccgggtttagggtaacggtcggggacgggtaacgacccgtagtcttcgggttaccttcggaagacgtccgacgacgcccgtaacccgcccgttcg

SEQ ID NO: 315857 - DNA, 775 bp, Homo sapiens
  misc_feature: GZ8MTXP01AXQ8K.38.7.A07.1.454.CMB.2.raw
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtgggcacgagcagcaacgccatcgcagtgcatacaacntcagcagagacggcctggtactgatagaagtcttaatgtgagtcggaccaccgtacgaaccggaagggacgacggacttcccgagtacctcgtcttccgtcgacggtccctaccggnggtcccgtcgggtcgggggtaccttagggaccggtcccgtacccttaaacccctccgtaacccctaacttccccgttaccccgaacccggttcccccttacccggtaaaccggttccgttaacggggaaacgggtaagttacggggaaacgggtccggttaaacgggttaaccctttaacgtttaaccggttcggttaacccggacggggttaccgggggtttaccggggaaccgttccggggttccggggtttacccggggttttgggggtaaccgggtttccgggggaacggggttaaccggggaacccgtaaacgggtcccgttacgggttaccccggttacggtaaccggggtaccgaacccgggtaccccggtaccggttccccggttccccggcccccggtttaaccgg

SEQ ID NO: 315858 - DNA, 655 bp, Homo sapiens
  misc_feature: GZ8MTXP01AI5OF.38.7.A07.1.454.CMB.2.raw
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgcatcgcatggcatcaacatcagccagacgaacggccctaggtactgatgaaagtcttaangtgatcggacctaccctnaacccgaagggacgaccgggatccctgtacctacgcttacgaccgaggccttccgaagtctacggtggggctggacgccgtacctacctccaacctacgtcctaccgacgtcccctaccgtagttaccgtaggacgggtacttacgggacgtacgttacggtaacgttacgttaccggtcgttaccgaagggtaccgggttacgggggacttaccggttcgggttcccgggtttttagggggaacctttcgggggacgggtaaacgggttaccgaaacggtccgttacggttacccggttaccggtaaggttccgaacggtaccccgagggttcccttcccggttcccccgttaacgg

SEQ ID NO: 315859 - DNA, 487 bp, Homo sapiens
  misc_feature: GZ8MTXP01EMGV8.38.7.A07.1.454.CMB.2.raw
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
tcagtcgatcacgtcacgaccggtgctcgatttagcacgtgtcgcagggggctggggagtcagcaccatggcttggacccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgccatcgcatgggccaatcaacatcaagccaganaaagggccctggacttgatgaaagcttaatagtgataggcaccctgaccaaggganacgggatcccngatcgntntcaggctccaagctctggggctgagcgctacctnaccatctccagcctccagtcngagatgaggctgactatacngtcagacgtggggctatggccgttgggaattcggnggagggccaaagcttgcgttctaaggcaagcccaaggctgcccctcgg

SEQ ID NO: 315860 - DNA, 585 bp, Homo sapiens
  misc_feature: GZ8MTXP01DT50V.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaatagtgatgggacacctacgaaccgaaaggggagacggggactcccgtagactccgtcttactcgaagggcctccgagtccgtcgtcgggggctcggacgcgcctacctcacctactcctccacgtccctccgagtcgtaggacggtagttcggaagggtccttaggtaacttacgttaaccgtcggtacgacggtacgggtcggggtcctacggttcggtaccggtttggggtacgttcggggacgggtacgggacccgaaggccgtcggacccgtcgtacggtcgacgcccgaaggtcccg

SEQ ID NO: 315861 - DNA, 713 bp, Homo sapiens
  misc_feature: GZ8MTXP01BH47Q.38.7.A07.1.454.CMB.2.raw
  modified_base (172)..(172): a, c, t, g, unknown or other
  misc_feature (172)..(172): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtggcacagcagcaacgcatcgcagtgacatacaacatcagacgaaggaggaacgggcccttacggtacgtgatagaaagtacttaagtagtgacgttcggacccctaccgtaccgaacggaaacgggggacgaaccggggtacttacccgtgtacccgttacgtcctttcgaccgacgggtccctacccgaaggtccgttaccgggtcggggtaccgttacggaccgggtccgtaacccttaccccgtaccctaaacccgtccttacccggtacccctaccgtccccgtacccgtaaagtttccggtaggacgggtacgtaggtaacgtcgtacggttaaacttacgttaacgtcgtacgaggtacgggtacggggtacgtaccggttcggttccgggtttagggtaaccgggttcgggacggggtaacggttaaccgtaagtcggttacgttccggttccggtaacggtccgaacggaccgacggccgtaacccgttccccggttccg

SEQ ID NO: 315862 - DNA, 602 bp, Homo sapiens
  misc_feature: GZ8MTXP01CFBB0.38.7.A07.1.454.CMB.2.raw
  modified_base (172)..(172): a, c, t, g, unknown or other
  misc_feature (172)..(172): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgccatcgcatggcatcaacatcagccagacgaagggccctaggtacttgatgaaagtcttaaatggtgatcggacaccctacaaccgaagggagaccgggatcccgtgacccttcggcttcgtcgacgggtcctccgaagcgtacgttcgggggactggaacgtccgtaccctaccctacaaccctactccgtacccagtccctacctagtctggacggaatgacggtcttaggtacttagttaccgtagtaccgacggtacggttggggcctacggttggtaccgggtttgggtaacgttcggggcgggtacgggaccgtaacggtcgacggttcccgttcgtaagtaccgaacgcccgaagggccctcccggccccgtccgg

SEQ ID NO: 315863 - DNA, 570 bp, Homo sapiens
  misc_feature: GZ8MTXP01ARTS5.38.7.A07.1.454.CMB.2.raw
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (422)..(422): a, c, t, g, unknown or other
  misc_feature (422)..(422): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtgggcacagcagcaacgccatcgnatggcatcaacatcagccagagacggccctggtactgatgaagtcttaaagtagtgatcggccacccctacgaaccgaagggggtacgacgggtactcccgtgactcgtacttcgtcgacggcctccaaggtcctcggtcggggctggacgccgactaccctcacccactccgacccagccctcagtccgtagngaagtgacggctgtaacttactacgtgtcgacggtacggtcggggctacgtcggtccggtttgggaacgttcgggacggtacggaccgagtcgttacgttccgttcgtaacgtcaaccggtaccacgggttcctcccgccccgtccgg

SEQ ID NO: 315864 - DNA, 681 bp, Homo sapiens
  misc_feature: GZ8MTXP01BMX8F.38.7.A07.1.454.CMB.2.raw
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcagtgggcacagcagcaacgcatcgcatcggacatacaacatcacgccgaaggacggaacggcccctggtactgatagaagtacttaaagtagtgactcgggacccaacccgtacgaaccggaagggacgacgggtacctcccgtagactcgtctacncgcggtcctcgagtctcggcggggctggacgtcgaccgttaccnctaacctacgttccaccgacgtccctaccgtaacgttccggtaggaacggtacggtcgggtacgggtaccttacggtaaactttacgtaaccgttcggtaaccggtaacgggtccggggttacgggccttaccgggttaacggttccggggttttaggggtcggttaccgggggaacggggtaaccggttacccgttacggcccggtaacgggtaccccggttaacgaccgggttaccgaccggtaacccggttaacgggttcccccgg

SEQ ID NO: 315865 - DNA, 738 bp, Homo sapiens
  misc_feature: GZ8MTXP01E04QN.38.7.A07.1.454.CMB.2.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgnatgcatcaantcagcagagacggccctggtactgatagagctttaangtgatcggaccaccctacgaaccgaaggggacgacggactccgtagacctcggtcttcgacgacggcctaccgaaggtccgtcggtcggggactacggaaccggtcccgtaaccccttaaccccgtaaccaaaccccttacgttacccctaacccgaaaccggttcccctaacggtaacgttaccgtaagggaaccgttaagtaccggaacggttaccttaacggtaaactttaaccgttttaacgaccggttaaaccggaacggggttaaccggggttacggggaacccgttaaaccgggttcggggtttaaccccgggggttttaaggggaaaccggttaaccgggggacgggaaaccgggttaaccaaacgggtccgttaaccgggttacccgggttaccttaacggggaccctaaccgggacccccgtaacgggccccgttccccggaaccccgtttccgg

SEQ ID NO: 315866 - DNA, 605 bp, Homo sapiens
  misc_feature: GZ8MTXP01B360L.38.7.A07.1.454.CMB.2.raw
  modified_base (283)..(283): a, c, t, g, unknown or other
  misc_feature (283)..(283): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaanagtgatggcacctcaaccgaagggacgacgggactcccgtgactctctcacgcgtcctacgcgtcgtcgggcggtcgcggacgcgtaccctaccaccacctaccttccctaccgaccgtccctaccgtacgtcgtaggaggtagggtaggacggtacgtacgtacgttaacttacgtacgtacggtacgggtacggggtcgggtcgtcggtcgggttcgggtttcgggttacgggttcggggtacggggaacgggacggacgttacggtaaccggtacccggtaaccggtacggtacgaccgtaaccggaaccggtccccgg

SEQ ID NO: 315867 - DNA, 622 bp, Homo sapiens
  misc_feature: GZ8MTXP01BTBCJ.38.7.A07.1.454.CMB.2.raw
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgccctcccgtgggacgcctcggtcacgctcacctgcactctgagcaggtgggcacagcagcaacgccatcgcatggacatcaacntcagcagagacggcctggtactgatagaagtcttaanagtgagtcggccaccgtacgaacgaaggggacgacgggtactccgtagaccgtcgtcttccgacgtacggcctccgcggtcgtcgggtggggtctcggacgtcgcctacctcaacctntccnccgacgtcctcgtacgcgtaggagagtggacggtctaagtacttagtacgtcgacggtacggtcggtcggggactcgggttcgggtttcccgggtttaggggtaaccgttacgggggcggggtaaacggttccgaaacggtccggttacggttacccggttcggtaacggccgtaaccggacccggtacgttcccgtccccggttccccggttaacgg

SEQ ID NO: 315868 - DNA, 639 bp, Homo sapiens
  misc_feature: GZ8MTXP01EV82V.38.7.A07.1.454.CMB.2.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (380)..(380): a, c, t, g, unknown or other
  misc_feature (380)..(380): n is a, c, g, or t
tcagtcgatcacgtcacgaccggtgctcgatttagcacgtgtcgcagggggagagctctggggagtcagcaccatggcttggaccccactcctcttcctcacccctcctcctccactgcacagggtctctctcccagcttgtgctgactcaatcgccctctgcctctgcctccctgggagcctcggtcacgctcacctgcactctgagcgaggtggcacagcagcaacgccatccganagngacanacaacanacacgacgaaggacggaacggtccgtaggtatagagtagaagtacttaaagtagtagagtcgacctaccgacgaacggaagggacgacggtaccctccgtagacgtctcttacgacgcgcctaccgngtcgtacgggtggggctacggacgcctacctaccgtaccaacctacgtacctaccaccgtacccgtacgtacgtacgtaaggaacggtacggtaggtacggtactacgtaacttagttacgttacggaccgtaggtacgggtacgggacgttcggtcgggttcgggtttaggggtacggttaccggggacgggtaacgggaaccgttaggttccgtaaccggtacgtaacgtacgaccgacgtaacccgaacggtcccg

SEQ ID NO: 315869 - DNA, 708 bp, Homo sapiens
  misc_feature: GZ8MTXP01ECSK3.38.7.A07.1.454.CMB.2.raw
  modified_base (182)..(182): a, c, t, g, unknown or other
  misc_feature (182)..(182): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctcgcctcccgtgggacncctcggtcacgctcacctgcactctgagcagtgggcacagcagcaacgcatcgcagtggacatacaacatcgacgccgaaaggtacggaaacgggcccctacggttacttaggaagtaggtaaaggtctttaaaagtaggtgtaagtccggaccctaacccgtacgaaacccggaaagggggacggaaccggggtacctccccgtagacgtccgtccttacgaccgaacgggtcccttaccgagggtcccgtcgggtcgggggaccttaggacgcccggtacctaacccgtacctaccctatccctaccgaaccgtccccgtacgtaacggttcgtaacggacggggtattcgggtacgggtacttacggtaacttacgttaccgtggtaccgtaggtacggggtcgggtctacggtcgggttccgggtttagggtaccggtttcggggacggtacgggaaccgttacgggcgtaaccggggtacctcggttaacgggccaaccgggtccgttaaccggtccccgg

SEQ ID NO: 315870 - DNA, 648 bp, Homo sapiens
  misc_feature: GZ8MTXP01A7S6R.38.7.A07.1.454.CMB.2.raw
  modified_base (183)..(183): a, c, t, g, unknown or other
  misc_feature (183)..(183): n is a, c, g, or t
  modified_base (249)..(250): a, c, t, g, unknown or other
  misc_feature (249)..(250): n is a, c, g, or t
  modified_base (435)..(435): a, c, t, g, unknown or other
  misc_feature (435)..(435): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatccgccctctgcctctcgcctcccgtgggacncctcggtcacgctcacctgcactctgagcaggtggcacagcagcaacgcatcgcatggcatcaacnncagccagagacggccctggtactagatgaagtcttaagagtgatcgacaccgtcgaaccgaagggacgacggacctccgtagtactccgtcttaccgcgaacgggcctcccgagtccgttacgggcggggctacggacgccgtacctaccctccaaccgtactccctcccgacgtcccttaccgngttaccgtgggtaacgtggggtacggtacgggtcttacggaacctttacgttacgtcggtaccgtacgggtaccgggtgggaccgttcggtcgggtttccgggtttaggggtaccggttccgggggtacgggaacgggttacccgttagggttcccgtaacgggacccgttcggtaccgggacgttacccggaacccgttaacgggtcccccg

SEQ ID NO: 315871 - DNA, 587 bp, Homo sapiens
  misc_feature: GZ8MTXP01BIQ44.38.7.A07.1.454.CMB.2.raw
  modified_base (357)..(357): a, c, t, g, unknown or other
  misc_feature (357)..(357): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagaggaacgggccctcggtacttgatagaagtacttaaagtagtgaatcggaccacccgtacgaaccgaagggacgacggactcccgtgacctcgcttcgacgacggctccgngctcgggtgggctggacgcgtactacccgtcacctatccctaccgacgtaccctcgagttcgagaggatcggaacgtcgtagtaccgttattacgtgtacgaggtccgggtagggctacggtcggttccggtttgggtaacgttcgggacggggacgttacgaggtcgttacggttacccgttcgtaacgggccaacgcccgagggttccctaaccggttccccgtaacg

SEQ ID NO: 315872 - DNA, 710 bp, Homo sapiens
  misc_feature: GZ8MTXP01C8W52.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtgggcacagcagcaacgcatcgcatggacatacaacatcagaccaggacggacgggccctggtactgatagaaagtcttaagtaggtgagtcggaccaccccgtacgaaccggaaggggtacggaccgggactcccgtagtaccgtccgtactttcgtaccgacggtccctaccgtggtccgttccgggtgggggtcctacgggaccgtccgtacccttaacccctaccaaccctactcctaccccgtacgtccccttaccgtaggtccgtaggaacgggtgtacgggacggtcgttaacgaactttaacgttaccgtaggttaccgagggtacgggttacggggccttacggttcggggttaccgggtttgggggttaacggttccgggggacgggacgggttaaccgtaacgggtccgttaaccgggttcccggttaccggtaacgggtaccgaaccggtacccggtaacggttccccgttaacccggcccccgtttaaccgg

SEQ ID NO: 315873 - DNA, 692 bp, Homo sapiens
  misc_feature: GZ8MTXP01EVTRA.38.7.A07.1.454.CMB.2.raw
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (279)..(279): a, c, t, g, unknown or other
  misc_feature (279)..(279): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgccatcgcatggcatcaacntcagcagagaacggccctggtactgatagaagtcttaanagtgatggccaccgtcaaacggtaagggacgacgggactccctaggacctccggtcttcgtcgaacggtcccttaccgaaggtccttacgggcgggggtcctacggaacgccgtaccctacccgtacaaacctaacttcccgaccacggttacccctaccgtaaggttccgtagggaacggtaacgttgggaaacggtcgtaaggttaaacccgtttaatttaacgtccgttacgaaggtaccggggttcgggggaccttaaccgggttcgggttacccgggttttagggggtaacggttcgggggacgggaacggggaacccaaagggtccgttaaccggttacccggttaccggttaacggaccgaaccggacccggaacggttcccgttcccggttccccccgggttccg

SEQ ID NO: 315874 - DNA, 716 bp, Homo sapiens
  misc_feature: GZ8MTXP01DJKCP.38.7.A07.1.454.CMB.2.raw
  modified_base (263)..(263): a, c, t, g, unknown or other
  misc_feature (263)..(263): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctccagcttgtgctgactcaatcgcctctgcctctcgcctcccgtgggacgcctcggtcacgctcacctgcactctgacgcaggtcggacaacgagcacgaccaacgccagtccgacagtcggacatacaacanacgacgaccgaaggtaacgggaaccggtcccctagggtactttagagttagaaacgtactttaaagtacggtagtaagtccggaccctaacccggtacgaaaccggaaagggggacgaacggggtacctccccggtaagccttccggcctttccgacgaacggtcccttacccggacgttccggttacgggcgggggtacttacggggcctaccggtacccttacccgaccgtaacccttactcccgttacccgacggttccctaaccgttgaccggttaggaaccgggtgttacgggacggttctacggtaacttacgttagtcgtaaaccggtcgggtacgggtcgggccttcgggttaacggttcgggttcgggttcggcggggtacgggaacggttacgacggttccgtaacgggtacgtccgaaggccgaccgtccgaacggtccccg

SEQ ID NO: 315875 - DNA, 614 bp, Homo sapiens
  misc_feature: GZ8MTXP01E2Y1Z.38.7.A07.1.454.CMB.2.raw
  modified_base (183)..(183): a, c, t, g, unknown or other
  misc_feature (183)..(183): n is a, c, g, or t
  modified_base (237)..(237): a, c, t, g, unknown or other
  misc_feature (237)..(237): n is a, c, g, or t
  modified_base (239)..(241): a, c, t, g, unknown or other
  misc_feature (239)..(241): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgccctcccgtggggacnccgtcggtcacgctcacctgcactctgagcaggtggcacagcagcaacgcatcncnnncncncncncncncncncncncncncncnctacggtaccgtacggtacgtacgtaacgtacgtaacgtacgtaagtacgtacgtacgtacgcgccccgcgcgcgtcgtcgtaccgtaccgtcgtacgtctcgtcgtcgtcgtcgtcgtacgtacgtcgtcgtcgtcgtccgtacgtcgtcgtcgtcgtcgcgcgcgacggcgtaccgtaccgtacgtccgtccgtaccgtaccgtaccgtaccgtaccgtaccgtacgtacgtaaccgtaccgttaccgtaccgttaccgtaccgttaccttaccgttaccgttaccgtaaccgtaccgttaaccgttaccgttaccgttaccgtaaccgttaaccgttaaccg

SEQ ID NO: 315876 - DNA, 663 bp, Homo sapiens
  misc_feature: GZ8MTXP01CEYEJ.38.7.A07.1.454.CMB.2.raw
  modified_base (241)..(241): a, c, t, g, unknown or other
  misc_feature (241)..(241): n is a, c, g, or t
  modified_base (295)..(295): a, c, t, g, unknown or other
  misc_feature (295)..(295): n is a, c, g, or t
  modified_base (425)..(425): a, c, t, g, unknown or other
  misc_feature (425)..(425): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcaggtggcacagcagacaacgcatcgcagtgcatcaanatacagccaaggacgaacgggtccctggtactagactagaaagtactttaaagnggtcaagttcggaccctaacccctacggaaacgaaagggggacgacgggtactcccgtagtacctccgtacttcacgacgtcctacgaagtccgtcgggtcgggctacggacgccgtacccttaaccccnctaacctcgtcccgtaccgacgtacccgttacgtacgttacgaggacgtagtacgggtacgtacgttaacgtaacttacgttacgtacggtacgaacgggtacggtacggtccgtacggttcgggttacggtttagggtaaccggttcggggacggtaccgacgtacgtccggttaaccgttccggttaccggtaacgacccgccgtacccggtacgttccccgtcccgttcccgtcg

SEQ ID NO: 315877 - DNA, 666 bp, Homo sapiens
  misc_feature: GZ8MTXP01A1QWJ.38.7.A07.1.454.CMB.2.raw
  modified_base (357)..(357): a, c, t, g, unknown or other
  misc_feature (357)..(357): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagaccgagacggaacgggccctacggttactgatagaagtacttaagtagtgagtcggccaacccgtcgaacgaaggggacgacgggacctcccgtgacgtcgtcttacncgaaggcctccgagtcgtcggtcggggctacgacgcgtacctacctaccaccctacgtacctacccgacgtccccgtaccgtacgttcgtacgggaagggtacgggttacgggacggtacgttacggttaactttaacgttaccgtacggttacggtaacgggtaccggggtcgggggtaccgtaacggttcgggtttccgggtttacggggtacggttccggggaccggggtaacgggaacccgacggttccggtaacggtacccggttaaccggtacgggtaccgaccggtcccgaacgggtccccg

SEQ ID NO: 315878 - DNA, 695 bp, Homo sapiens
  misc_feature: GZ8MTXP01AZH0G.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagacggcctcggtactgatgaagtacttaatagtgagtcggcctacccgtacgaaccgaagggacggacgggacctccgtagacgtccgcttacgtcaacgggtctacccgaggtccgtcggtcgggggctcggacgcgtacctacccgtcctaaccctacttccgtaccccgtacggtccccttacccgaacgggttcctacgggtaacgggtacggtaacggggtaggggtaccccttaaggttaaacttaaccgtttacgttacggtaccgtaacggtaaccggggttcggggtaccgttaaacggttccgggtttcccggggtttaggggttaccgggttccggggaacggggtaacgggaacccgttcggaccggttaacgggtaccccggtaacgtttaacggggccttaaccgggccccgttaacgggttcccccg

SEQ ID NO: 315879 - DNA, 725 bp, Homo sapiens
  misc_feature: GZ8MTXP01C83WQ.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatccgccctctcgcctctcgccctcccgtgggacgcctcggtccacgctcacctgcactcgtgacgcaggtcgggcaacgagcagaccaaccgcctatccgacagtcggacagtacaacactacgacggaccgaaagggacggaaaccgggtccccgttaggttacgtagagtagaacgtactttaaagtagtgtacgtcgacccacccgtacgaaccggaaggggacgaccggtacctcccggtagacgtccgtacctcgtacgcggtcctaccgacgtcgtacggtggggtactacggtaccgttaccgttaccctaccaccgtactcccgaccgtaccgtcctaccgagttaccgacggaagtacgtacgggggacgttacgtaacgttaaccgtttagttaaccgttcggttaacggacgggttaccgggtacgggtaccgttacggtttcgggttaaccggggtttgggttacggttaccggggacgggtaaacggaccgttacggttccgttacggtaacccgtacgtaacggtaccgtacggacccgtaaccggccgttaacccccgg

SEQ ID NO: 315880 - DNA, 625 bp, Homo sapiens
  misc_feature: GZ8MTXP01B4ZVP.38.7.A07.1.454.CMB.2.raw
  modified_base (181)..(181): a, c, t, g, unknown or other
  misc_feature (181)..(181): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
  modified_base (571)..(571): a, c, t, g, unknown or other
  misc_feature (571)..(571): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctccctggggacncctcggtcacgctcacctgcactctgagcaggtgggcacagcagcaacgccatcgacatcggcatcaacatcagccaaggagaacggccctggtacttgatagaagtacttaaagtagtacggagtcgggaccctaacccgtacgaacccggaaagggggacgaaccgggggtacctccccggtaggtacttcccggtactttaccgcgaacgggctacccgagtccgtcgggtcgggggctcgggacgtcgtcctaccgcaaccgctacctccgactcctacngtcagcggtagtggnggtctagacgttattcgtcgtagacggtccggtggggacctaggtcgggttccggtttaggggtcggttcgggacgggtacggttaaccgngggttaccgtcggtacccgtaaccggtggtccgacggcccgttaacggtccccg

SEQ ID NO: 315881 - DNA, 731 bp, Homo sapiens
  misc_feature: GZ8MTXP01BOK6Z.38.7.A07.1.454.CMB.2.raw
  modified_base (391)..(391): a, c, t, g, unknown or other
  misc_feature (391)..(391): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagacggaacgggtccctcgggtacttggactaggaaagtctttaaagtaggtgaatcgggaccctaacccgtcgaaacccggtaaagggggacgaaccgggactccccgtgaacctcggtacttccgtacaacgggtccctacccgnggtcccgtcggtcgggggtctcggaacgtcccgtaccctaccccttacaaccctacttccctacccgacggtcccctaccgtacgttccgttaggaacgggtattcgggaacggtccgttacggtaaaccgtttacttaacggttcggttaccgaacgggtaaccgggttacgggggtccctaaacgggtttccggggttcccgggttttagggggtaaccggttcccgggggacgggtaaccggggacccgaaagggttccgttaccggttacccggttaccgttaacgggtacccgaacggaccccggacgggttccctcccggttcccccgttcggg

SEQ ID NO: 315882 - DNA, 688 bp, Homo sapiens
  misc_feature: GZ8MTXP01D5E3G.38.7.A07.1.454.CMB.2.raw
  modified_base (252)..(252): a, c, t, g, unknown or other
  misc_feature (252)..(252): n is a, c, g, or t
  modified_base (408)..(408): a, c, t, g, unknown or other
  misc_feature (408)..(408): n is a, c, g, or t
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatccgccctctgcctctgccctccgtgggagcctcggtcacgcctcacctgcactctgagcaggtgggcacgagcaagccaacgccatcgcagtggacatacaactnacgacgaccgaggaacggaaacgggtcccttaggtaacttggaataggtaaactacgtttaaagtaggtcgtaacgtcggacccaaccccgtacgaaccggaagggggacggacgggtactcccgtagacctccgtcttcgtacgacgccctacgnggtcgtcgggtcggggtctacggacgtctacccttaccctacaccctactccgtaccgaacgtaccctcgagttcgaggagagttaggaaccgtggtacgtaactttacgttaacgtcggtacgtaacgggtacggtcggggacttaaccgggtgggttaccggtttggggtaacggttccgggggacgggtaacgggttaccgtaagggtcttacccgggttaccgttcggtaacggccgaaccggtaccggcgggttccctcccggccccgtaaccgg

SEQ ID NO: 315883 - DNA, 647 bp, Homo sapiens
  misc_feature: GZ8MTXP01BQMPL.38.7.A07.1.454.CMB.2.raw
  modified_base (172)..(172): a, c, t, g, unknown or other
  misc_feature (172)..(172): n is a, c, g, or t
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgcatcgcatggcatcaacntcagccagacgaacgggccctaggtactgatgaaagtcttaangtgatcggcctaaccctacgaaccgaaggggacgaccgggactcccgtagacctccggcttcgtcgacggtcccttaccnggtcctcgggtgggggacctgggaacggccgtacctaccctcaacctactccgtccgaacgtcccctaccgagttccgtaggacggtagtacgggtacggtacgtacggttaacttacttaacgtcgtaccgaggtacggttcggggctacggtcggttccgggtttgggtaacggttcgggcgggtaacgggaccctaaaggtcccgttacggttacccgttaccggtaacgggtccgaacggtccccgtaagggttcccgttcccgggttcccccgtttccggg

SEQ ID NO: 315884 - DNA, 709 bp, Homo sapiens
  misc_feature: GZ8MTXP01B4P2H.38.7.A07.1.454.CMB.2.raw
  modified_base (516)..(516): a, c, t, g, unknown or other
  misc_feature (516)..(516): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactcgtgacgcgaggtgggcacgagcagaccaaccgccagtcgacagtcggactactacaaacactacgaacgaccgaaggaacgggtaaccggggtccccgttacggttaacttaggacgttaggtaaagttacgtttaaagtaggttaggacgttcgggacccaacccgttaccgaaacggaacgggggacgaccgggtacctaccccggtgtacgtccgtacttaccgcgaacggtcctccgacgtccgtcggggtcggggctaggaccgtcgtacctaccgtcacctactcccgtaccaccgtccctacgngtcgtagggacggtacggtggtacggacttagtaacgttacgttacgtgtaacggcggtacggggtcggtctacggttcggttccgggtttggggtaaccgttcggggaacggggtaccggttaacggttcgttaccggttaacgggacccgtcgggtaacggccttacgggtaacccggttaacggtccccg

SEQ ID NO: 315885 - DNA, 697 bp, Homo sapiens
  misc_feature: GZ8MTXP01EXQPT.38.7.A07.1.454.CMB.2.raw
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtggcacagcagacaacgccatcgacagtggacatacaaacatacgaacgaccgaaggaacggtaaaccggggtccccttagggtaacttaggaataggaaacgtactttaaaataggttagactcggacccaacccgtacgaaaccggaaagggggacgacgggtactcccgtagtaccgtcgtactttcgacgacggtccctacgaacgtcgttaccggggcgggactacggacgtccgtaccctaccctaccaacctacgtcctaccgacgtaccctacgtacgtacgaggagtagtacgacggtacgtaacgtaacgttaacgttacgtacgtacggacggtacgggtacggtaccgttcggttcgggttaccgggtttgggtaacggtcggggacgggtaacggaacgtaacggtccgttaccggttccgttacggtaacggtaccgaaccgtaccggtacggttcccgtccccgttccccggtcg

SEQ ID NO: 315886 - DNA, 663 bp, Homo sapiens
  misc_feature: GZ8MTXP01A3X0J.38.7.A07.1.454.CMB.2.raw
  modified_base (178)..(178): a, c, t, g, unknown or other
  misc_feature (178)..(178): n is a, c, g, or t
  modified_base (206)..(206): a, c, t, g, unknown or other
  misc_feature (206)..(206): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgancagtggcacagcagcaacgccatcgcagtggcatcaacatcagccagaggaacggcccctggtactgatacgagtcttaaagtagtgagtcggacctaacccgtcgaaaccgaaaggggtacgaccggggtactccccgttagaacgtccgtcttcgaccgaaggtccctaccgaggtcctcggggtgggggtctacggacggccgtaccttaacccctaccaaccgtaccttcccgtaccgtacgtcccctacgtacgtcgtaagggaacgtacggtacggacggtactacgtaacttacgttacgtacgtacggtacggtcgggtacggtacgtacggttcgggttccggggtttagggtaccgggttacggggaacgggtaaccggttacggacggttccgtaacggtacccgttaacgtacggtaccgacccggtaacccgttaaccggtccg

SEQ ID NO: 315887 - DNA, 685 bp, Homo sapiens
  misc_feature: GZ8MTXP01ASFAX.38.7.A07.1.454.CMB.2.raw
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtggcacagcagcaacgccatcgcatggacatacaacatcgagccgaagaacggaacggcccgtacggtactagatagaagtcttaaagtagtgagtcggacccaacctacgaacgaaaggggacgacgggacctcccgtagacgtccgacttacgtacgaacggtcctaccgnggccttcgggngggtactcgacgccgtacctaacctccaacctctaccctaccaccgtcctaccgacgttccgaggtaacggtagtacggacggtaccgtacggttaaccttaagtttaccgtacgtacggtaacggtaaccgggtacggggtccgtaacggttcgggttccggggtttaggggttaaccggttccgggggtaaacgggtaaccggggaaccgttaacggttccgtaacccgggtacccggttaaccggttacgggtaccgaacccgggccccgttaaacgggtccccccgg

SEQ ID NO: 315888 - DNA, 638 bp, Homo sapiens
  misc_feature: GZ8MTXP01DTTXL.38.7.A07.1.454.CMB.2.raw
  modified_base (172)..(172): a, c, t, g, unknown or other
  misc_feature (172)..(172): n is a, c, g, or t
  modified_base (242)..(242): a, c, t, g, unknown or other
  misc_feature (242)..(242): n is a, c, g, or t
  modified_base (491)..(491): a, c, t, g, unknown or other
  misc_feature (491)..(491): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtgggcacagcaagcaacgccatcgcatcggcatcaacngtacacgaccaggtaggaacgggtccctcgggtaacttgataggaaacgtcttaaatagtgtaagtcggacccaacccctcgaaaccggaaagggggacgaccggggtactcccgtagacccgtccggtacctttctacgacggtccctcgaaggtcgttcgtgggggcttgggacggtccgtcccttaacctccaacctctccctctacgacccgtcctaaggtctagggaacggtgtaacggcggtntacgtaacctttagttaaccgtgtacccgtaagggtcgggtaggcgttaccggtgtccggggtttggtaagtcgggcgggtacggacgtagtccgagttccccgttagtcggacgtaaccgcgacgccgtcccgttcccgttaaccg

SEQ ID NO: 315889 - DNA, 791 bp, Homo sapiens
  misc_feature: GZ8MTXP01AL9GU.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaaacatcagccagagaacgggccctggtactgatgaaagtcttaatagtgatggaccaccctacgaaccgaaggggacgaacggggactcccgtagacctccggtcttccgtacgacgggtcctcccgaaggtccgtcggttcgggggccttgggaacggtccgtacccttacccgtacccaaccccgtactcccgttaccccgaaccgtccccgttacccgtaacggttccggtacgggtaaacggggtaacgttacgggtaacggggtaccggtttacgggttaaacccttttaacgtttaacccgtcgggttacccggtaacggggttaacccggggttcggggggtacccttaacccggggttccggggtttaccccgggggttttagggggttaaaccggtttcccggggggacggggttaaaccgggggaaccccgtaaacggggtcccggttacccgggttaaccccgggttacccgggttaacgggccgtaaccgggacccccgtaacgggttccccgttaacccgggcccccccgtttaacccgggg

SEQ ID NO: 315890 - DNA, 644 bp, Homo sapiens
  misc_feature: GZ8MTXP01D6SA3.38.7.A07.1.454.CMB.2.raw
  modified_base (154)..(154): a, c, t, g, unknown or other
  misc_feature (154)..(154): n is a, c, g, or t
  modified_base (174)..(174): a, c, t, g, unknown or other
  misc_feature (174)..(174): n is a, c, g, or t
  modified_base (242)..(242): a, c, t, g, unknown or other
  misc_feature (242)..(242): n is a, c, g, or t
  modified_base (468)..(468): a, c, t, g, unknown or other
  misc_feature (468)..(468): n is a, c, g, or t
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctntgcctctgcctccctgggancctcggtcacgctcacctgcactctgagcagtgggcacagcagcaacgcatcgcatggacatacaacntacagccagacgaacggccctggtactgatagaagtacttaagtagtgacgtcggaccacccgtacgaaaccggaagggggacgaaccgggtactccccgtagtaccgtccgtactttcgcgacgggtccctaccgaagtccgtcgggtcgggggcctaggacgccgtacctacccgtcaaccctcgtcctacccgaacgtccccttacgaggtccgtaggaacgngtacggacgtcgttagaacgtttagtacgtgtacgaggtcggtgggactacggttcggttccggtttgggtaacggtccgggacgggtaacggaccgaaggtccgttacgggttccggttacgtaacgggtccaaccggtcccgacggttcccgtaacccggttccccgttaacgg

SEQ ID NO: 315891 - DNA, 667 bp, Homo sapiens
  misc_feature: GZ8MTXP01CR4LR.38.7.A07.1.454.CMB.2.raw
  modified_base (185)..(185): a, c, t, g, unknown or other
  misc_feature (185)..(185): n is a, c, g, or t
  modified_base (423)..(423): a, c, t, g, unknown or other
  misc_feature (423)..(423): n is a, c, g, or t
tcagtcgatcacgtcacgaccggtgctcgatttagcacgtgtcgcagggggagagctctggggagtcagcaccatggcttggaccccactcctcttcctcacccctcctcctccactgcacagggtctctctcccagcttgtgctgactcaatccgccctctgcctctcgccctcccgtgggacncctcggtcacgctcacctgcactctgagcaggtggcacagcagcaacgcatcgcagtggacatacaaacatcacgaccgaaggaacggaaacgggtcccctaggttactgaatagaagtacttaaagtagtgactcgggaccaacccgtagaaccggtaaaggggacgaccggggtaccccttccggtagacgtcccgtccttacgtacgaacgggtcctaccgacgggtcgtacggngggggtctggaccgtcgtacctaccctcaacctactcctaccgacgtccctacgacgtcgaggacgaggtacggagtctagtacttagtacgtgacgaggtacgggtcgggcctacgggttcggttccgggtttaggggttacgttcgggggtaccgggaaggttaaccccgagggttcccgtaacgggtaaccccgttcgggttaacgggcccgaaccggtaacccggttaaccggtccccgg

SEQ ID NO: 315892 - DNA, 634 bp, Homo sapiens
  misc_feature: GZ8MTXP01A7GBZ.38.7.A07.1.454.CMB.2.raw
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggacgcctcggtcaccgctccacctgccactctgagcaggtgggcacagcagcaacgccatcgcatggacatacaantcagccagacgacggccctggtactgatcgaatcttaaangtgatcggcctaccgtagaaccgtaagggggacgaccgggtactcccgtagtaccctcggtacttcgtcgacggtcccttaccgaaggtccgttaccggngggggtccctgggaaccgtccgtacctaccctacaccctatcctccaaggtccctaccgtagtcgtaggaggngtacgcgtacgtagtacttagttacgtcgtacgacggtacggtcgggtcctacgggttcggtcgggtttgggtaacggtcgggacggggtaaccggttaaccgtacgggtccttacccggttccgttaccgtccgaccggaacccgtaaccgaccccttaccgtcgttcgtaaccc

SEQ ID NO: 315893 - DNA, 755 bp, Homo sapiens
  misc_feature: GZ8MTXP01B9EM0.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctccagcttgtgctgactcaatcgccctctcgcctctcgcctccgtgggacgcctcggtcacgctcacctgcactctgagcgaggtgggacacgagcacgaccaaacgccagtcgcagtggacatacaacactacacggccaaaggtaacggaaccgggtccctaggtacttaggaatagtaaagtacttaaagtagtacgagtaccggacctaacccgtacgaaaccgggaagggaacggaccggtactcccgtagtaacctcggtacttacgacgtacggtcctaccgtcgtccgtacgggtaccggggtcgtacggaaccggtcccgtacccttaccccgttaccgaaaccctacgtaccccgtaccccgtaacgtcccccttaccgggaagtttcccgggaagggacgggtactaacggggtaccgttacggtaacggtttaacctttgtttaaccgtacggcgtaacggggtacggtcgggttaccctaacgggtttccgggttcgggtttaggggtaaccggttcgggggaacgggtaaccgttaacgtaaccggtcgttacccggtttccgaaccggttggacccgcggtaaccccggtcgcccgttcccgttcccgtttaacccg

SEQ ID NO: 315894 - DNA, 621 bp, Homo sapiens
  misc_feature: GZ8MTXP01BS68E.38.7.A07.1.454.CMB.2.raw
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (438)..(438): a, c, t, g, unknown or other
  misc_feature (438)..(438): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtgggcacgagcagcaacgccagtcgcatcggcatacaacatcagacagacggacggcctaggtactgatagaagtcttaataggtgagtcggacctaccgtacgaacgaagggacgacggtttttacncgtagactcgtcttcgacgacgccttcncggtccgtggcggggtctacggacgtcgtcctaacctcaacctcgtccaccacgtacctacgtacgtcgtaggacgngtaggacggtctacgttacttacgttacgtagtcgacgggtacggtcggtacgtaccggttcgggttcggtttagggtaacggttcgggggacgtaccgggactaacgggtccgttaaacggccgttaccggtggtaccgaaccggaccggtacgttccccgtaacgttcccccggttaaccg

SEQ ID NO: 315895 - DNA, 720 bp, Homo sapiens
  misc_feature: GZ8MTXP01CQFL0.38.7.A07.1.454.CMB.2.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (561)..(561): a, c, t, g, unknown or other
  misc_feature (561)..(561): n is a, c, g, or t
  modified_base (665)..(665): a, c, t, g, unknown or other
  misc_feature (665)..(665): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctccagcttgtgctgactcaatcgcctctgcctctgcctccgtgggacgcctcggtcacgctcacctgcactctgagcagtgggcanagcagaccaaacgccagtcgcagtcggacatacaaacganaccagaccgaaggaacggaacggccctacggtacttgatagaaggtacttaaagtaggtagagtacggacctaccccgtacgaaaccggaaggggacggtaacgggaccttacccgtaggtaaccctccggtacttcgtaccggaaggtcccgttacccgaaggttcccgtcggggtaacgggggttcctacggggaaaccgtccgtaaccccttacccgaaccctaacccggaactcctacccgacggtaaccctccgtaagtccggaaggtagacgtaggtaacgcgttaggtaactttacgtagtacncggtaggacgggttggggacctagtccggtcgggttgggtaagtccgggggttacggaaacggaccggtaaacggtcgttaccggggttaccctttacgggggnttaacccggccggaacccgaaccggttcccggttccccgccccgtttaacccggg

SEQ ID NO: 315896 - DNA, 545 bp, Homo sapiens
  misc_feature: GZ8MTXP01C8KAL.38.7.A07.1.454.CMB.2.raw
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaanatcagccagagaaggccctggtactgatgaagcttaanagtgatggcaccctcaaccgaagggagacgggatcctgactcgacttcncaggctccngctcgtgggctgacgcgctacctnacctatcctccagcctcagtctagagactgaacggcgtacggacttaatttaccgtgtaccgaggaacggttcgggggctaacgtgggtcccggtttggggttaacgttcgggggacggagggttaccgaaaggcttcggcccgttcgtaacggacaacggcccgaaggttcctcgttcccccgtcg

SEQ ID NO: 315897 - DNA, 712 bp, Homo sapiens
  misc_feature: GZ8MTXP01BDLBU.38.7.A07.1.454.CMB.2.raw
  modified_base (328)..(328): a, c, t, g, unknown or other
  misc_feature (328)..(328): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgacgtcaggtgggacacgagcacgacaacgccagtccgacagtcggacactacaaacactacgacgaccgaaggaacggaacggtcccgtacggtacttagagtacgaagtcttaaagtagngtagtcggaccctaccgtacgaacggaaggggacggacggtaccctcccgtagtacgtcccgtcgtttaacccgacgaacggtcctaccggtacgtccgttacggggtacggggccttacggacggtacccgttaccgtaaaccctccgtaacccgtaccttacccgtacccgtaaccgttccccgtaacgtacgttaccgtaaggtaccggtaggggtacgtacggggttacttaacgtaacggttacttacggtacgttaccggacggttaacgggtcgggtcttaacggttcgggttccggttaggggtcgttcggggacgggtaacggttacgcgttacgtcggtccgtaacgttcggacaccggtccgaaccggtcccg

SEQ ID NO: 315898 - DNA, 757 bp, Homo sapiens
  misc_feature: GZ8MTXP01C8F2U.38.7.A07.1.454.CMB.2.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccgtgggacgcctcggtcacgctcacctgcactntgagcaggtggcanagcagcaacgcagtcgcagtggactactacaaacatacgagacccgaaggaacgggaaaccgggtccccttacgggtaactttaggaacgttaggaaacgttacgttaaagtaggtacggaaacgttccgggaacccaaccccgttacgaaaccgggaaaggggacgtaaccggggaccttccccggtagacttccggtacctttcgacgaacggtcctaccgaacggtcgtcgggtacggggctacgggactccgtaccctaacccgtaccaccgtaactcctacccgtacggtccccgtactaacggtccgtaaggggaacggtgggttacggaacgggtccttaacggtaacctttaacgttacgtacggttaccggacgggtaaccgggtcgggggaccttaacgggttcgggtttaccgggtttaggggtaacgttccggggaaaccgggtaacggacccgttcgggttaccgttaaccggggtaacccgtcggttaacgggaccgttacccggcccggttaacgggtcccccg

SEQ ID NO: 315899 - DNA, 500 bp, Homo sapiens
  misc_feature: GZ8MTXP02G3M7T.38.7.A07.1.454.CMB.2.raw
  modified_base (335)..(335): a, c, t, g, unknown or other
  misc_feature (335)..(335): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccaagggagacgggatccctgactcgcttctcaggctccngctctggggctgagcgctacctcacccatctccagcctccagtctgaggatgaggctgactattactgtcagacgtggggcacgtggccgtttgggtacttcgggcggacgggaccaagcgtcgaccgtctaagggtcaacgcccaaggcctcgcccccgttcgg

SEQ ID NO: 315900 - DNA, 554 bp, Homo sapiens
  misc_feature: GZ8MTXP02JZW1W.38.7.A07.1.454.CMB.2.raw
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaatagtgatgggcaccctcaaccaaggggagacggggactccctgatcgcttcncngctcagctcgtgggctgacgcgcctacctcacctactcctccacgtccctccgagtcgtaggaggagtggaggtctacgtacttacgttacgtgtacgaggacggtgggactacgttcggttcgggtttaggggtacgttccggggacgggtacgggaccgtaacggtcgtaacggtacccggtccgtacggtaccgaccggtacccggacggtccg

SEQ ID NO: 315901 - DNA, 554 bp, Homo sapiens
  misc_feature: GZ8MTXP02GPTE1.38.7.A07.1.454.CMB.2.raw
  modified_base (339)..(339): a, c, t, g, unknown or other
  misc_feature (339)..(339): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaaatagtgatggccaccctcaaccgaagggagacgggatcccgtgactcgcttctcaggctcngctcgtggggctgagcgctacctcaccatcctccacgccctccagtctgagatggaggctagactattacgtgtacaggacggtggggctacgtggtccggtttggggtacgttcggggacgggtacggggaacccgaaaggtccgtacggaacccggttccgtaacgggtccgaacggaccccgaacggggtcctcccggacccccgttccggg

SEQ ID NO: 315902 - DNA, 527 bp, Homo sapiens
  misc_feature: GZ8MTXP02GH8R6.38.7.A07.1.454.CMB.2.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaggccctggtactgatgaagcttaaatagtgatggcaccctcaccgaaggganacgggatccctgactcgcttcncaggcctccngctcgtggggctgagcgctacctcaccatctccagccctccagtctgagatgaggctgactattacngtcagacggtggggcacgtgtccggtttgggtacgttcggggacgggacgggacccgaaaggcgtacggacccgttccgtaaggtccgaacggaccccgaaacggccgtccggcccccgttccggg

SEQ ID NO: 315903 - DNA, 502 bp, Homo sapiens
  misc_feature: GZ8MTXP02JSX2E.38.7.A07.1.454.CMB.2.raw
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctnaccaagggagacgggatccctgactcgcttctcaggctcngctcgtggggctgagcgctaccctcaccatctccacgccctccagtctgagatgaggctgactattactgtcaggacggtggggcacgtgccgtttgggtacgttcgggcgggacgggaccaaggctcggacccgtcgtaaggtcacgcccaaggcctcgcccctcgg

SEQ ID NO: 315904 - DNA, 532 bp, Homo sapiens
  misc_feature: GZ8MTXP02GWVWD.38.7.A07.1.454.CMB.2.raw
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctnaccaagggagacgggatcccgtgactcgcttcncaggctccngctcgtggggctggacgcgctacctcaccatctccagccctccagtcctagaggatggaggctagactattactgtacgagacggtgggctacgtgccgtttgggtacgttcggggcggtacgggaccaaaggccgttacggaccgttacctaagggtacacggacccgaacggtcctaccggcccccgttccggg

SEQ ID NO: 315905 - DNA, 527 bp, Homo sapiens
  misc_feature: GZ8MTXP02I8D9R.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacgggcctggtacttgatgaagcttaatagtgatggcacctcaaccgaagggagacgggactcccgtagactcgacttctcgacggctccgagcctcgtgggggctgacgcgctacctcaccatcctccacgccctccagtcctagaggatgaggctagactattactgtacaggacgtggggcacgtcggtccggtttgggtacgttcgggacgggtacggacccgaaggcgtaaggacccgtacgtacggtcgacgacccgaaggtcccg

SEQ ID NO: 315906 - DNA, 606 bp, Homo sapiens
  misc_feature: GZ8MTXP02JT2WE.38.7.A07.1.454.CMB.2.raw
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctaggtacttgatgaagtcttaatagtgatggccacctcaaccgaagggacgacggactcccngatcgctcncnggctcgagctcgtggggctggacgccgactacctcaccactcctccacgccctccagtcctaggacggtagtggacggtcttacggtaacttaactttaccgtggttaccgaacggtaaccggggttcgggggacctaacggttcgggttcccggggttttaggggtaacgtttccgggggaccggggtaacggggaacccgtaaagggtccgtaaccggtaacccggttacgtaacggggtccaccggtaccccggaaagggtcccccg

SEQ ID NO: 315907 - DNA, 511 bp, Homo sapiens
  misc_feature: GZ8MTXP02H0QJ6.38.7.A07.1.454.CMB.2.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaaacatcagccagagaagggccctcggtacttgatgaagcttaanagtgatggcaccctcaccgaagggngacgggatcccgtgactcgcttcncgaggctccngctcgtgggggctggacgcgcctacctcaccatccnccacgcctccagtctgagatggaggctgactattacngtcgagacggtgggctacgtgtccggtttgggtacgttcgggacgggacggacgaacgcgtcgaccgtcgtaaggtcgacgccgaggcctcgcccctcg

SEQ ID NO: 315908 - DNA, 529 bp, Homo sapiens
  misc_feature: GZ8MTXP02JN42D.38.7.A07.1.454.CMB.2.raw
  modified_base (335)..(335): a, c, t, g, unknown or other
  misc_feature (335)..(335): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaatagtgatggcaccctcaaccgaagggagacgggatcccgtgactcgcttctcaggcctcngctcgtggggctgacgcgctacctcaccatctccagccctccagtctgagatgaggctgacttatactgtacagacggtggggcacgtgtcggtttgggtacgttcggggacgggaacgggaccgaaggccgtacggtacccgtacgtaacggtaccacggaccccgaaggtcccgtaccggcccccgttcggg

SEQ ID NO: 315909 - DNA, 514 bp, Homo sapiens
  misc_feature: GZ8MTXP02GSQCW.38.7.A07.1.454.CMB.2.raw
  modified_base (342)..(342): a, c, t, g, unknown or other
  misc_feature (342)..(342): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaatagtgatggccacccccgacgaagggagacgggatcccgtgactccgcttctcaggctccagctcgnggggctgagcgctacctcaccactctccagccctcacgtctgaggatgaggctgactattactgtacagacgtggggcacgtgtccgtttggggtattcggggacggagggtaccgaaggcgtcggaccgtccgtaggtccgacggcccgaaggtcctcggccccgtggtcc

SEQ ID NO: 315910 - DNA, 516 bp, Homo sapiens
  misc_feature: GZ8MTXP02HPTC6.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaatagtgatggcaccctcaccgaagggagacgggactcccgtgactcgcttctcgaggctccagtcctcgtggggctgacgtcgctacctcaccatcctccagccctcagtctgacgatggagctgactatactgtcagacgtggggcacgtcggtccggtttgggtacgttcgggacggtacggaccgtaaggcgtaacggaccgtcgtacggtcgacggacccgtaacggcccg

SEQ ID NO: 315911 - DNA, 509 bp, Homo sapiens
  misc_feature: GZ8MTXP02HIJ0U.38.7.A07.1.454.CMB.2.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctcggtacttgatgaagcttaaanagtgatggcaccctcaccgaagggagacgggatcccgtgactcgcttctcaggctcngctcgtggggctgagcgctacctcaccatctcacgcctccagtctgagatgagctgactatactgtcagtacggtgggcacgtggtccgtttagggtacgttcgggcggacggggaccaaggcgtacggccgtcgtaaggtccacggcccaaggcctaccggcccccgtcgg

SEQ ID NO: 315912 - DNA, 516 bp, Homo sapiens
  misc_feature: GZ8MTXP02I6KB8.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagtcttaatagtgatggcaccctcaaccgaagggagacgggactccctgactcgcttctcnggctccagctcgtggggctgagcgctacctcaccatctccacgccctcagtctaggagatgagctagactatactgtacaggacggtgggctacgtcggtccggtttgggtacgttcgggacgggtacgggaccgagccgtggacccgtccgtacggtacacggacccgaaggtcccg

SEQ ID NO: 315913 - DNA, 484 bp, Homo sapiens
  misc_feature: GZ8MTXP02GJF7O.38.7.A07.1.454.CMB.2.raw
  modified_base (333)..(333): a, c, t, g, unknown or other
  misc_feature (333)..(333): n is a, c, g, or t
  modified_base (435)..(435): a, c, t, g, unknown or other
  misc_feature (435)..(435): n is a, c, g, or t
tcagtcgatcacgtcacgaccggtgctcgatttagcacgtgtcgcagggctggggagtcagcaccatggcttggacccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccaagggagacgggatccctgactcgcttctcaggctccngctctgggggctgagcgctacctcaccatctccagcctccagtctgagatgaggctgactattactgtcagacgtggggcacgtgccgtttgggtattcggnggacgggaccaagctgaccgtcaaggtcagcccaaggctcgcccctcgg

SEQ ID NO: 315914 - DNA, 498 bp, Homo sapiens
  misc_feature: GZ8MTXP02I6OPG.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggcccctggtacttgatgaagcttaatagtgatcggcaccctcaaccgaaggggagacggggactcccgtagatcgtcttctcaggctccgagctcgtggggctggacgcgcgtacctcaccatctccacgcctcagtctgaggactggagctgtactatactgtcagtcgtgggcacgtgtcgtttggcgtcgggcggtacggacaaggctcgaccgtcgtacggtcacgaccaggtcc

SEQ ID NO: 315915 - DNA, 671 bp, Homo sapiens
  misc_feature: GZ8MTXP02HYIRQ.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaagtcttaagagtgatcggcaccctcgaaccgaaggggagacgggactcccgtagactccgtcttccgtacgacggggtccttacccgacggtcccgttcgggttcggggggacttcgggaacgcccgtacccgtaaccctccgaaccctaacttccctaccccgacgtcccctacccgtacgttccgttaaggacgggtaaacgtcgggtaacgggtaccttagggtaaacccttaatttaaccgtcggttaccgaaggtaaccgggttgggggacctacggttcggtcccgggttttaggggtaacgtttcgggggacgggtacggggaaccgtaaggtccgtaacggtaccggttaccgtacgggtaccgacggtacccgtaacggtcccg

SEQ ID NO: 315916 - DNA, 496 bp, Homo sapiens
  misc_feature: GZ8MTXP02JDWAH.38.7.A07.1.454.CMB.2.raw
  modified_base (285)..(285): a, c, t, g, unknown or other
  misc_feature (285)..(285): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (409)..(409): a, c, t, g, unknown or other
  misc_feature (409)..(409): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatcgaagcttaanagtgatggcaccctcaccgaagggacgacgggactcccgtgatcgcttcncnggctcagctcgtggggctgagcgctaccgtcaccatctccagcctccagtctgagatgagctgactagtacngtcagacgtgggctacgtcggtccgtttgggtacttcgggcggtagggacccaagcgtggaccgtcgacggtcacgcccgaaggtcc

SEQ ID NO: 315917 - DNA, 535 bp, Homo sapiens
  misc_feature: GZ8MTXP02HQOJ2.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaatagtgatggcaccctcaaccgaagggacgacgggactcccgtgactcgcttcgcagggcctccgagcctcgtgggggctggacgcgcctacctcaccatcctcccacgccctccagtctggaggatggagtctagactattactgtacaggacgtggggcacgtcgtccggtttgggtacgttcgggacgggtacgggaccgtaaggcgtaacggtaccgtccgtacggcgtaccggacccgtaacggtcccg

SEQ ID NO: 315918 - DNA, 523 bp, Homo sapiens
  misc_feature: GZ8MTXP02IZ2WV.38.7.A07.1.454.CMB.2.raw
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggcccctggtacttgatgaagcttaaatgtgatggccaccctcaaccgaaggggagacgggactcccgngactcgcttcncnggctcagctcgnggggctgagcgctacctcaccatcctccacgccctcagtctgaggatgagctagactagttactgtacagacggtgggacacgttcggtccggtttggggacgttcggggacggtacgggaccaaggcgtcggaacccgtccgtaagggtcaccggacccgtaaggcccg

SEQ ID NO: 315919 - DNA, 491 bp, Homo sapiens
  misc_feature: GZ8MTXP02GWKD0.38.7.A07.1.454.CMB.2.raw
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaaanagtgatggcacctcacaaggagacggactcccngatcgcttcncnggctcagctcgtggggctgagcgctacctcacatctccagcctccagtctagaggatgaggctgactatactgtcagacgtgggcacgtcgccgtttgggtacttcgggacgggacgggaccaaggcgtgaccgtccgtaggtcacggcccgaaggtcccg

SEQ ID NO: 315920 - DNA, 528 bp, Homo sapiens
  misc_feature: GZ8MTXP02HPQY5.38.7.A07.1.454.CMB.2.raw
  modified_base (334)..(334): a, c, t, g, unknown or other
  misc_feature (334)..(334): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaatagtgatggcaccctcaccgaagggagacggggatcccgtgactcgcttctcaggctcngctcgtggggctgagcgctacctcaccatctccagcctccagtctgagatgaggctgactattactgtcaggacgtggggcacgtgtccggtttggggtacgtttcggggacgggacgggtacccaaaggtccgtacggtaacccgtccgtaacgggtcaacggtccccgaaagggcctcggcccccgttcggg

SEQ ID NO: 315921 - DNA, 552 bp, Homo sapiens
  misc_feature: GZ8MTXP02IB5KJ.38.7.A07.1.454.CMB.2.raw
  modified_base (333)..(333): a, c, t, g, unknown or other
  misc_feature (333)..(333): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaaatagtgatggcaccctcaccgaagggagacgggatcctgactcgcttctcaggctcngctcgtgggggctgagcgcctacctcaccatcctccacgccctccagtctaggagatggaggctagtactattactgtacaaggacggtggggctacgtcggtccggtttggggtacgttcggggacgggaacgggtaacccgaaagggtccgtacggtacccggttaccgtaacgggtccgaacggaccccgaaagggccctcggaccccccgttcgg

SEQ ID NO: 315922 - DNA, 485 bp, Homo sapiens
  misc_feature: GZ8MTXP02GKDBU.38.7.A07.1.454.CMB.2.raw
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccacgcatggcatcaacatcagccagagaagggccctggtactgatgaagcttaaatagtgatggcaccctnaccaagggagacgggatccctgatccgcttctcaggctccagctctggggctgagcgctacctcaccatctccagcctcagtctgagatgagctgactatacngtcagacgtgggcacgtgccgttgggtattcggcggaggggaccaaggctcgaccgtccaggtcacgcccaaggctcgcccctcggtccg

SEQ ID NO: 315923 - DNA, 526 bp, Homo sapiens
  misc_feature: GZ8MTXP02GDACD.38.7.A07.1.454.CMB.2.raw
  modified_base (339)..(339): a, c, t, g, unknown or other
  misc_feature (339)..(339): n is a, c, g, or t
  modified_base (408)..(408): a, c, t, g, unknown or other
  misc_feature (408)..(408): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccgaaggggagacggggatcccgtgactcgcttctcaggcctcngctcgtggggctgagcgctacctcaccatctccacgccctccagtcctgagatgaggctgactattacngtacaggtacgtggggcacgtggtccgtttagggtacgttcgggacggtacgggaccgaacggtcgtacgacccgtcgtaacggtcgacgacccgaaggccgtcggcccccgttccgg

SEQ ID NO: 315924 - DNA, 558 bp, Homo sapiens
  misc_feature: GZ8MTXP02HHM2W.38.7.A07.1.454.CMB.2.raw
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgcatcgcatggcatcaacatcagccagagaacgggcccctaggtacttgatgaagcttaaatgtgatggccaccctcaaccgaaggggagacggactcccngactcgtcttctcgacggctccgagccttcgngggggctggacgcgtacctaccctcaccatcctaccacgtccctccagtcctaggaggtactggaggcttaggtaacttagttacgtgttacgaggtaccggtggggacctacggttcggtccggtttggggtacttcgggggacggtacggaacaggtcgtaacgtacccgtacgtacggaccgacgaccgacggtcccg

SEQ ID NO: 315925 - DNA, 530 bp, Homo sapiens
  misc_feature: GZ8MTXP02HWKBI.38.7.A07.1.454.CMB.2.raw
  modified_base (281)..(281): a, c, t, g, unknown or other
  misc_feature (281)..(281): n is a, c, g, or t
  modified_base (426)..(426): a, c, t, g, unknown or other
  misc_feature (426)..(426): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaggccctggtactgatgaagcttaanagtgatggccaccctcaaccgaaggggacgaacggggactccccgtgatcggactttcgcacgggcctcgagccgtcgtgggggcctgacgcgctacctcaccatctccacgcctccagtctggacgatgaggctgactattacngtacagacggtgggcacgtcggccggtttgggacgttccgggacgggtacgggaccaaggcgtaacggacccgtaccgtacggaccacggacccgtaaggcccg

SEQ ID NO: 315926 - DNA, 547 bp, Homo sapiens
  misc_feature: GZ8MTXP02HSMVZ.38.7.A07.1.454.CMB.2.raw
  modified_base (340)..(340): a, c, t, g, unknown or other
  misc_feature (340)..(340): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaatagtgatggccaccctcaaccgaagggagacgggactcccgtgacctcgcttctcgaggcctcngctcgtggggctggacgcgcctacctcaccatcctccacgtccctcctagtctggaggagtggacggtctagtacttattactgtacgaggacggtggggctacgttcggtccggtttgggtacgttcggggacgggacgggtaccgaacgcgtacgaccgtcgtaacggtcgacggacccgaacggtcctaccgtcccccgtacgg

SEQ ID NO: 315927 - DNA, 489 bp, Homo sapiens
  misc_feature: GZ8MTXP02GQUU2.38.7.A07.1.454.CMB.2.raw
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcgagtgggcacgagcagcaacgccatcgcatggcatcaacatcagccagagaaggcctcggtacttgatgaagctatagtgatggcacctcaccaaggagacggagtacctgactcgctctcagctcncgctcgtgggcgtgagcgctactcacactcncncncncncncgngagngngagntagtatatactgtacgagacgtcggcgacgtcgtcgttcggtacgtcggacggacggacgacgacgtacgtacgtacgtaacgtacgacgacgacgcgtccgccgtcg

SEQ ID NO: 315928 - DNA, 599 bp, Homo sapiens
  misc_feature: GZ8MTXP02JCOJS.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctccctgggacgcctcggtcacgctcacctgcactctgagcagtgggcacagcagcaacgccatcgcatggcatacaacatcagccaaggaggaacgggcccctacggtacttgatagaagtcttaatagtgatcggccaccctcgaaccgaaggggacgacgggactcccgtagactcgtcttccgcgacgggtcctccgagcctcgtggggctgacgcgctaccctcaccatcctaccacgtccctcagtctaggacgagtggacggctagtaaccttattacgtggtacgaacggtacgggtcggggactacggttcggttccgggttttaggggtacggttccgggggacggggtacggggtaacccgaacggtccgtaacggtacccggttaccgtacgggtccgaccggacccgaacggtccccg

SEQ ID NO: 315929 - DNA, 544 bp, Homo sapiens
  misc_feature: GZ8MTXP02IS1N8.38.7.A07.1.454.CMB.2.raw
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggcccctggtactgatgaagcttaatagtgatggccaccctcaaccgaagggagacgggactcccgtgactcgcttctcncggcctcgagcctcgtggggctgacgcgcctaccncaccatcctacccacgccctcacgtctagaggagtggagctagtacctatactgtcagacggtggggctacgtggtcccgtttgggtacgttcgggacgggtacgggaccgtaacggccgtaacggtacccgtaccgtacgggtaccgaccggtacccggaacggtcccg

SEQ ID NO: 315930 - DNA, 523 bp, Homo sapiens
  misc_feature: GZ8MTXP02G7TLX.38.7.A07.1.454.CMB.2.raw
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaaatagtgatggcaccctcaaccgaagggagacgggatcccgtgactcgcttcncgagctcngctcgnggggctgagcgctacctcaccatctccagcctccagtctggagatggaggctgtatattacgngtcgagtacggtgggctacggtgtccggtttgggtacgttcgggaggggtacgggaccgaaggcgtacggacccggtccgtaaggtcgacggcccgaagggtcctccggccccttccgg

SEQ ID NO: 315931 - DNA, 557 bp, Homo sapiens
  misc_feature: GZ8MTXP02H1550.38.7.A07.1.454.CMB.2.raw
  modified_base (240)..(241): a, c, t, g, unknown or other
  misc_feature (240)..(241): n is a, c, g, or t
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgccatcgcatggcatcaacnncagccagagaacggccctggtactgatgaagcttaanagtgatcggacaccctacaaccgaaaggggagaacgggactcccgtgactcgcttcncgaggctccgngctcgtggggctgacgcncctacctcaccatccnccacgcctaccagtccgtaggagagtaggacggtcctaggtaactagttaccgtgtacgacggacggtggggctacgtcggtcggttgggtacgtcggggacggacggaccgaacggtcgacggtaccgtaccgtaacggacgaacgcccgaacggccctaccggtcccccgtccgg

SEQ ID NO: 315932 - DNA, 516 bp, Homo sapiens
  misc_feature: GZ8MTXP02J2KN8.38.7.A07.1.454.CMB.2.raw
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaatgtgatggcaccctnaccgaagggagacgggatccctgactcgcttctcaggctccngctcgtggggctgagcgctacctcaccatctccagcctccagtctgacgatgaggctgactattactgtcagacggtgggcacgtgtccgttgggtacgttcgggcgggacgggaccgaacggcgtacggacccggttccgtaaggtccgacggccccgaaggcccttccggcccccttccgg

SEQ ID NO: 315933 - DNA, 571 bp, Homo sapiens
  misc_feature: GZ8MTXP02IDUJ0.38.7.A07.1.454.CMB.2.raw
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctcccgtgggagcctcggtcacgctcacctgcactctgagcagtggcacagcagcaacgccatcgcagtggcatcaacatcagccagagaacggcctacggtactgatagaagtctaataggtgagtggaccaccctacgaaccgaaggggagacgggacctcccgtagactcgacttcncgcgctccgagtcgtcgtggggctggacgcgacctaccncaccactcctaccacgtccctccgacgtctagacggataggagtctagacttagttacgtgtacgaggtacggtgggactacggtcggtaccggtttagggtacgttacggggacgggtacgggacccgtaaggcgtaacggtacccgtaccggtacggtaccgacgtacccgtaacggcccgg

SEQ ID NO: 315934 - DNA, 550 bp, Homo sapiens
  misc_feature: GZ8MTXP02JVVBG.38.7.A07.1.454.CMB.2.raw
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggcctcggtactgatgaagcttaatagtgatggaccacctcaaccgaagggagacggactcctgactcgcttcncgnggcctcagctcgtggggctggagcgctacctcaccatcccnccacgtcctacagtcgaggagtagtggacgtctagtacttagttacgtgtacgaggtacgggtcgggactacggttcggtcgggtttagggtacggtacggggacgggacgggaccgaacggtccgtaacggtacccggtacgtacggtaccgaccggtaccggaacggtcccg

SEQ ID NO: 315935 - DNA, 530 bp, Homo sapiens
  misc_feature: GZ8MTXP02IZ7ET.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaaccgaaggggagacgggactccctgactcgcttctcaggctccagcctcgtgggggctgagcgctacctcaccatctccagccctccagggtctggagatggagctgactattactgtcagacggtgggcacgtcggtccggtttgggtacgttcgggacgggtacggggaccaaggtccgtaacggacccgttcgtaacgggtccgacggacccgtaacggggtcccg

SEQ ID NO: 315936 - DNA, 492 bp, Homo sapiens
  misc_feature: GZ8MTXP02FR3RU.38.7.A07.1.454.CMB.2.raw
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (398)..(398): a, c, t, g, unknown or other
  misc_feature (398)..(398): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaatagtgatgggccaccctcaaccgaaggggacgacgggactccctgatcgcttcncnggctccagctgtggggctgagcgcctacctcaccatcctccagccctcagtctgaggntgagctagactatactgtcagcgtgggcagtcgtcgttgggtattcgggacggtacgggaccagctcgaccgtcgtaggtcacgcccgagtccg

SEQ ID NO: 315937 - DNA, 486 bp, Homo sapiens
  misc_feature: GZ8MTXP02I9LV7.38.7.A07.1.454.CMB.2.raw
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (398)..(398): a, c, t, g, unknown or other
  misc_feature (398)..(398): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaatgtgatggcacctcacaggagacggatccctgatcgcttcncnggctccagctgtggggctgagcgctacctcaccatctccagccctccagtctgaggatgaggctgactattacngtcagacgtggggcacgtcggtccgtttgggtacgttcggacgggaggaccaagctgacccgtctacgggtcacggcccgtaaggccg

SEQ ID NO: 315938 - DNA, 669 bp, Homo sapiens
  misc_feature: GZ8MTXP02F51RS.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagaccagaggaacggccctggtacttgatgaagcttaatagtgatggccaccctacaaccgaaaggggacgacgggactcccgtagacctccgtccttctacgacggcctccgaggtcctcggtcgggggctagggacggtccgtacccttaacccgtcccaaccctaactccctacccgaacgtccccctacccgtaacggttccgtagggaacgggtacgttagggaacgggtcttaacggtaactttaacgtttacgtacggttaccgagggtacgggtcgggggacctacggttcgggttaccgggttttaggggtaacggttccggggacggggtaacgggtaaccgtaacggtccgtacggacccgttacggtaacggtaccgacggtacccgaacggtcccgtccggtcccccgttaccgg

SEQ ID NO: 315939 - DNA, 550 bp, Homo sapiens
  misc_feature: GZ8MTXP02H4RXO.38.7.A07.1.454.CMB.2.raw
  modified_base (239)..(239): a, c, t, g, unknown or other
  misc_feature (239)..(239): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaaggccctcggtacttgatgaagtcttaaatagtgatggcacccctnaaccgaagggagacgggatcccgtgactcgcttctcaggctccngctcgtgggggctggagcgctaccctcaccatcctcccagtccctccacgtctacggagatggaggctgacttattactgtcgagacggtggggctacgtggtccggttttgggtacgttcggggacgggtacgggaaccgtaaacggcgtacggtacccgtccgtaagggtccgaacgcccgaaaggcccgtccggtacccccgttcgg

SEQ ID NO: 315940 - DNA, 638 bp, Homo sapiens
  misc_feature: GZ8MTXP02J2C9K.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaatagtgatggccaccctcaaccgaagggacgacgggactcccgtgactcgcttcncgacgggtcctcccagccgttcgtcgggggcttggacgccgtacttaccctcaacccatccctaccacggcccttaccgagttccagggacggagttgggacggtcgtaggtaaccttaattaccgtaggttacgaacgggtaccgggttacgggggcctaacggttcgggttcccgggttttagggggtacgtttaccgggggacggggtacggggtaacccgaaacgggtccgtaacggggtaaccccggttacggttacgggtaccgaaccggtaaccccggaacgggttcccccgg

SEQ ID NO: 315941 - DNA, 531 bp, Homo sapiens
  misc_feature: GZ8MTXP02IQ11K.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtactgatgaagcttaatagtgatggcaccctcaccgaagggagacggggatccctgactccgcttctcaggcctccngctcgtggggctgagcgctacctcaccatctcacgcctccagtctgacggatggaggtctagtacttattacgtgtcaggacggtggggactacgtggtccggtttggggtacgttcggggacgggacgggtaccgaaggtcgtacggtaccgtcgtaaggtcacggacccgaaggccgtcgcccccgttcgg

SEQ ID NO: 315942 - DNA, 543 bp, Homo sapiens
  misc_feature: GZ8MTXP02H0DCN.38.7.A07.1.454.CMB.2.raw
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgcctcacctgcactctgagcagtgggcacagcagcaacgccatcgcatggcatcaaacatcagccagagaacggccctggtactgatgaagcttaanagtgatggcacccctcaaccgaagggacgacgggactccgtgactcgcttctcgaggccttccnggcctcgtcgggggctggacgcgtacctacctcaccatcctccacgtcctcccgagtctagagataggaggctgtaacttagttactgtacaggacggtggggactacgttgtccggtttgggtacgttcgggacgggacggaccgtaaagtcgtacgtaccgtcgtaacggtcgaacgcccaaggcctcgccccgttcg

SEQ ID NO: 315943 - DNA, 495 bp, Homo sapiens
  misc_feature: GZ8MTXP02HYA5V.38.7.A07.1.454.CMB.2.raw
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaaacatcagccagagaaggccctggtactgatgaagcttaaanagtgatggcaccctnaccgaagggngaacgggatcccgtgactcgcttcncaggctccngctctggggctgacgcncctaacccncaccatcncncncncncgtcngagagngagntgtatatatgtgagaggnggcgacgtcgtcgttggtacgtcggacggacggacgacgacgtcgacgtacgtaacgtcgacgacgacgcgtccgcccgtccg

SEQ ID NO: 315944 - DNA, 520 bp, Homo sapiens
  misc_feature: GZ8MTXP02GAL35.38.7.A07.1.454.CMB.2.raw
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaatagtgatggccaccctcaaccgaagggagacgggatccctgactcgctctcaggctccngctcgtggggctgagcgctacctcaccatcncagcctccagtctgagatgaggctgactattactgtcgagacggtggggctacgtgtccggtttgggtacgttcgggcgggtacggaccgaacggccgtacggacccgttccgtaaggtccacggtacccgaaggtcctccggccccctccgg

SEQ ID NO: 315945 - DNA, 545 bp, Homo sapiens
  misc_feature: GZ8MTXP02HH9EQ.38.7.A07.1.454.CMB.2.raw
  modified_base (333)..(333): a, c, t, g, unknown or other
  misc_feature (333)..(333): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaatagtgatggcacctcaccgaagggagacgggactccctgatcgcttctcnggctcagctcgtggggctgagtcgctacctcaccatcctccacgccctccgagtccgtggacgatcggaggctgaaccttagttacgtgtcgagacggtggggctacgtggtcccggtttgggtacgttcggggacgggtacggggaaccgtaaggtccgtaacggaacccgttccggtacgggtaccgaccggcccggaaacggtccccgg

SEQ ID NO: 315946 - DNA, 526 bp, Homo sapiens
  misc_feature: GZ8MTXP02F9W44.38.7.A07.1.454.CMB.2.raw
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
tcagtcgatcacgtcacgaccggtgctcgatttagcacgtgtcgcagggggagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtactgatgaagcttaatagtgatggcaccctcgaccaaaggggagacgggatccccctgactcgcttcncaggctccagctcgnggggctgagcgctacctcaccatctccacgcctacagtctgaggatgacggctgactattacgtgtacgaggtacggtgggctacgtgtccggtttggggtacgttcgggacgggacgggtaccgaaggtccgtaggaacccgttcgtaacgggtcacggcccgaacggcgtcccgg

SEQ ID NO: 315947 - DNA, 529 bp, Homo sapiens
  misc_feature: GZ8MTXP02JMTRR.38.7.A07.1.454.CMB.2.raw
  modified_base (361)..(361): a, c, t, g, unknown or other
  misc_feature (361)..(361): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactttgagcagtgggcacagcagcaacgccatcgcatggcatcaacatcagccagagaagggccctcggtacttgatgaagcttaaatagtgatggcacctcaccaagggagacgggatcccgtgactccgcttctcaggctcagctcgtggggctgagcgctacctcnccaaatctcagccctcacgtctcgagatgaggctgacgtattactgtcagacggtcgggctacgtcggtccggtttgggtacggtttccgggacgggtaggggaccgaaggcgtcggaccgtccgtacggtcgacggacccgacggccgtccgcccccgtcggtcccg

SEQ ID NO: 315948 - DNA, 526 bp, Homo sapiens
  misc_feature: GZ8MTXP02FN56Z.38.7.A07.1.454.CMB.2.raw
  modified_base (334)..(334): a, c, t, g, unknown or other
  misc_feature (334)..(334): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaatagtgatggcaccctcaccgaagggagacgggatcccgtgactcgctctcaggctcngctcgtggggctgagcgctacctcaccatctccagccctccagtctgagatggaggctagacttattactgtacaggtacggtggggcacgtgtccggtttgggtacgttcggggcggacgggaccgaacggcgtacggacccgttacgtaacggtccgaacggccccgaaggcctaccggcccccgttcgg

SEQ ID NO: 315949 - DNA, 501 bp, Homo sapiens
  misc_feature: GZ8MTXP02GV6OS.38.7.A07.1.454.CMB.2.raw
  modified_base (283)..(283): a, c, t, g, unknown or other
  misc_feature (283)..(283): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggcctggtacttgatgaagcttaanagtgatggcaccctcaaccgaaggggagacgggactccctgactcgcttctcnggctcagctctgggggctgagcgctacctcacatctccagccctcagtctgagatgagctgactatactgtacgagacgtggggcacgtcgtccggtttgggtacgtttcgggcggtacggggaccaaggcgtgaccgtacgttacggcgacgcccgaaggcccg

SEQ ID NO: 315950 - DNA, 507 bp, Homo sapiens
  misc_feature: GZ8MTXP02IZS1C.38.7.A07.1.454.CMB.2.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaaacatcagccaagagaagggccctcggtacttgatgaagcttaaanagtgatggcaccctcaaccgaagggagaacgggatcccgtgactcgctttcncgaggctccagctcgngggggcctggagcgctacctcaccatctccagcctccagtctgagntgaggntgactattactgtacagacgtgggcagtgtcggttggtacgttcgggcgggaggaccaaagcgtacgaccgtcgtaaggtcacgacccgaaggctcgcccctcgg

SEQ ID NO: 315951 - DNA, 579 bp, Homo sapiens
  misc_feature: GZ8MTXP02IKGI1.38.7.A07.1.454.CMB.2.raw
  modified_base (337)..(337): a, c, t, g, unknown or other
  misc_feature (337)..(337): n is a, c, g, or t
  modified_base (369)..(369): a, c, t, g, unknown or other
  misc_feature (369)..(369): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaaatagtgatggcaccctcaccgaagggagacgggatcccgtgactcgcttctcaggcctcngctcgtggggctgagcgctacctcaccatccncacgcctccagtctggagatggacggtctaggtacttattacgtagacgaggacggtgggggacctaacggttcgggtcccgggttttaggggtaacgttcggggacgggtaacggggaacccgaaaggtccgtaccggtaaccggttccggtaacgggttccgaacggtaccccgaaagggtccccgttaccggaccccccgtttccgg

SEQ ID NO: 315952 - DNA, 518 bp, Homo sapiens
  misc_feature: GZ8MTXP02I8V81.38.7.A07.1.454.CMB.2.raw
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggcccctggtacttgatgaagcttaatagtgatggcaccctnaaccgagggagacgggatccctgatcgcttctcnggctcagctcgtggggctgagcgctacctcaccatctccagccctcagtctgaggatggagctgactatactgtcagacggtggggcacgtcggccggtttggggtacgttcggggacgggtacggggaacccgaaggccgtcggtacccggtccgtaacggtcgacggacccgaaggtcccg

SEQ ID NO: 315953 - DNA, 493 bp, Homo sapiens
  misc_feature: GZ8MTXP02IKLEX.38.7.A07.1.454.CMB.2.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (349)..(350): a, c, t, g, unknown or other
  misc_feature (349)..(350): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcgagtgggcacgagcagcaacgccatcgcatggcatcaacatcagccagagaagggccctggtactgatgaagcttaaangtgatggcaccctcacgaaggggagacggactccctgatcgcttcncgngcncagctgngggnngagcgcacncacntcncncnctcacgtcgngagagngagngtgtactatacgtgtgagaggtcggcgtacgtcgtcggttggtacggtcgggacgggacggacgaacgcgtaacgtacgtacgtacgtacgacgaccgacgcg

SEQ ID NO: 315954 - DNA, 569 bp, Homo sapiens
  misc_feature: GZ8MTXP02GCL3Z.38.7.A07.1.454.CMB.2.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaaatagtgatggccacccctnaaccgaaggggagacgggatccctgactcgcttctcaggcctcgngctcgtggggctggacgcgctacctcacctatcctccagccctccagtcgtagaggatggacggctagacttattaccgtgtacgaggtacggtgggggactacggtcggtccgggtttggggtacgttcggggacggggtaacgggaacccgaaggccgttacggacccggttaccgtaacgggtccgaacggtaccccgaaggtcccgtaccggcccccgttcgg

SEQ ID NO: 315955 - DNA, 497 bp, Homo sapiens
  misc_feature: GZ8MTXP02IMO0Q.38.7.A07.1.454.CMB.2.raw
  modified_base (332)..(332): a, c, t, g, unknown or other
  misc_feature (332)..(332): n is a, c, g, or t
  modified_base (409)..(409): a, c, t, g, unknown or other
  misc_feature (409)..(409): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccaagggagacgggactccctgatcgcttcncaggctccagctcgtgggggctgacgcgctacctcaccatctccagccctccagtctgaggatgagctgactatacngtcagacgtggggcacgtcggtccgtttggggtacgttcgggcggtacgggaccaagcgtgaccgtcgaggtcacgcccgaaggtccg

SEQ ID NO: 315956 - DNA, 552 bp, Homo sapiens
  misc_feature: GZ8MTXP02G1MLO.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaatagtgatggaccaccctcaaccgaagggacgacgggactcccgtagatcgcttctcgacggcctccgagctcgtggggctggacgcgctacctcaccatcctccacgccctccagtctacggaggatggaggtcctaggacttacgttacgtgtaccgaaggtcggtgggactacgtcggtccggtttagggtacgttcggggacgggtacgggaccgaaggtccgtaacggacccgtacgtacggtccgacggacccgaaggtccccg

SEQ ID NO: 315957 - DNA, 533 bp, Homo sapiens
  misc_feature: GZ8MTXP02IFA1N.38.7.A07.1.454.CMB.2.raw
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaagctttaaatagtgatggaccacccctcaaccgaaggggagacggggactccctgactcgcttctcaggctccngctcgtgggggctggagcgcctaccctcacccatcctccacgccctccagtctgaggatggaggtctgtacttattacgtgtacaggtacggtggggctacgtggtccggtttggggtacgttcgggacgggtaggaccaaggcgtcgaccgtcgaaggtcacgaccgaaggtcctcggcccctcgg

SEQ ID NO: 315958 - DNA, 506 bp, Homo sapiens
  misc_feature: GZ8MTXP02IFPYN.38.7.A07.1.454.CMB.2.raw
  modified_base (283)..(283): a, c, t, g, unknown or other
  misc_feature (283)..(283): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgatcagtggcacagcagcaacgccatcgcatggcatcaacatcagccagagaagggccctggtacttgatgaagcttaaangtgatggcacctcaccaagggagacgggatcccctagactcgcttctcaggctcagcctcgtggggctgagcgctacctcaccatctccagccctcagtctagaggatgaggctagactattactgtcagcgtggggcacgtggtccgtttgggtactttcgggacggtacggggacctaagcgtaacggacccgtaccgtaggtacgacggaccaaggcccg

SEQ ID NO: 315959 - DNA, 541 bp, Homo sapiens
  misc_feature: GZ8MTXP02HHW0S.38.7.A07.1.454.CMB.2.raw
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacatcagccagagaaggccctggtactgatgaagcttaanagtgatggcaccctcaccgaagggagacgggatccctgactcgcttctcaggctcngctcgnggggctgagccgctacctcaccatctccagccctccagtctgagatggagctgacttattacgtgtacaggacgtgggctacgtgtccggtttgggtacttcggggacgggtacgggtaccgaacggtccgtacggacccggttaccgtaacgggttaccgaacggaccccgtaagggtcccctaccggtccccccgtttcggg

SEQ ID NO: 315960 - DNA, 536 bp, Homo sapiens
  misc_feature: GZ8MTXP02GCDPF.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacgggccctggtacttgatgaaagtcttaaagtagtgatggaccaccctacaaccgaaggggacgacgggacctcccgtagactccgacttcacgaggcctccgagcctcgtggggactggacgcgtcctacctccacctactcctccacgcctcagtctagagagtgagtctagactatactgtcgagcggtgggcacgtcgtccggtttggacgttcgggacggacggtacgaagtcgtaacggaccgtacgtacggtacgaccgccgaaggtcccg

SEQ ID NO: 315961 - DNA, 593 bp, Homo sapiens
  misc_feature: GZ8MTXP02GUXT7.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtactgatgaagtcttaatagtgatcggcaccctcaacgaagggacgacggactcccgtgactcgtcttctcgacgggtcctccgagtcctcggtgggggctcggacgcgcctacctcacctactcctcccacgtccctaccagtcgtacggaggtagtcggaacggtctacggtaacttacgttaacgtcggtacgtaacggtacgggtcgggggacctacggttcgggtccgggtttaggggtacggttccggggacgggtaacgggaccgaaggtccgtaacggtacccggtacgtacggtccgacggacccgtaacggcccg

SEQ ID NO: 315962 - DNA, 593 bp, Homo sapiens
  misc_feature: GZ8MTXP02GO0RN.38.7.A07.1.454.CMB.2.raw
  modified_base (283)..(283): a, c, t, g, unknown or other
  misc_feature (283)..(283): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaanagtgatggccaccctcaaccgaaggggacgacgggactccctagactcgcttctcgacggtcctccaggtcctcggtgggggcctggacgccgacctaccctcacccaactccctccaacgtcccctaccgagtccgtaggacggattcgggaggtcctaggtaccttaacgttacgtggtaccagggtacggtcggggacctacgttcggtcccgggtttaggggttacgttccgggggacggtacgggaaccctaaggtccgtaacggtaccccgtcgtaacgggtccacggtacccgaacggtcccg

SEQ ID NO: 315963 - DNA, 526 bp, Homo sapiens
  misc_feature: GZ8MTXP02IDKP5.38.7.A07.1.454.CMB.2.raw
  modified_base (336)..(336): a, c, t, g, unknown or other
  misc_feature (336)..(336): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccaagggagacgggatccctgactcgcttctcaggcctccngcctcgtggggctgagcgctaccctcacccatcctcccagtccctccgagtctagacggatggaggctgactattactgtcagacggtggggcacgtggccgtttgggtacgttcggggcggtacggggacccaaaggccgtacgacccggtcgtaaggtcgacgcccgaaggcctcggcccccgttcgg

SEQ ID NO: 315964 - DNA, 554 bp, Homo sapiens
  misc_feature: GZ8MTXP02I5MP8.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagtcttaaatagtgatggcaccctcaaccgaaggggagacgggactcccgtgactcgtcttcctcgaggcctccgagcctcgtgggggctggacgcgtcctacctcaccatcctccacgtccctccagtctaggaggatggaggctagtactagttacgtgtcgaagcggtggggctacgtcggtaccggtttgggtacgttccggggacgggtacgggaccctaaggccgtaacggtacccggtaccgtacgggtaccacggaccccgaaggtcccg

SEQ ID NO: 315965 - DNA, 506 bp, Homo sapiens
  misc_feature: GZ8MTXP02I7QTN.38.7.A07.1.454.CMB.2.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaatagtgatggcaccctcaccgaagggagacgggactcccngatcgcttcncnggctccagcctcgtggggctgagcgctacctcaccatctccagccctccacgtctagaggatgagctagactattactgtcagacgtgggcacgtcggccggtttgggacgttcgggcggtacgggaccgaaggcgtggtacccgtacgtacggtcgacgcccgaaggccg

SEQ ID NO: 315966 - DNA, 523 bp, Homo sapiens
  misc_feature: GZ8MTXP02IB5OS.38.7.A07.1.454.CMB.2.raw
  modified_base (339)..(339): a, c, t, g, unknown or other
  misc_feature (339)..(339): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtactgatgaagcttaatagtgatggcaccctcaaccgaaggggagacgggactcccgtgactcgcttctcnggctccagctcgtggggctgagcgctacctcaccatcctccagccctccagtcgtggggatggaggctgacttattacgtgtcagacgtggggctacgtcgtccggtttgggtagttcgggacgggacggtaccgaacgtctcggtaacccgtcgtacggtccacggcccgaacggcctcccgg

SEQ ID NO: 315967 - DNA, 562 bp, Homo sapiens
  misc_feature: GZ8MTXP02GDAIT.38.7.A07.1.454.CMB.2.raw
  modified_base (344)..(344): a, c, t, g, unknown or other
  misc_feature (344)..(344): n is a, c, g, or t
  modified_base (399)..(399): a, c, t, g, unknown or other
  misc_feature (399)..(399): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctacggtacttgatgaagtcttaatagtgatggccaccctcgaccgaaggggagacgggatcccgtgactcgacttctcgaggcctcngctcgtggggctgagccactacctcaccatcctaccacgccctccagtcgtgagntaggacgctgaacttatacgtgtacgaggtacggtgggactcgtcggtccggtttgggtacgttcgggacgggtaacgggaccgtaacggtccgtaccgtacccggtaccgtaaacggtcccgaacggacccgaacgggtcctacccggtacccccgttccgg

SEQ ID NO: 315968 - DNA, 495 bp, Homo sapiens
  misc_feature: GZ8MTXP02IKBCC.38.7.A07.1.454.CMB.2.raw
  modified_base (338)..(338): a, c, t, g, unknown or other
  misc_feature (338)..(338): n is a, c, g, or t
  modified_base (408)..(408): a, c, t, g, unknown or other
  misc_feature (408)..(408): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaaatgtgatggcaccctcaaccgaaggggagacggactcccgtgactcgcttctcnggctccagctcgtggggctgagcgctactcaccatctccacgcctccagtctgaggatgaggctgaactntactgtcagacgtgggcacgtcgtacgtttgggtacgttcgggcggtacggaccaagcgtcgaccgtcgtaggtcacgccgaagccg

SEQ ID NO: 315969 - DNA, 668 bp, Homo sapiens
  misc_feature: GZ8MTXP02H9PBL.38.7.A07.1.454.CMB.2.raw
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggacacgagcgagaccaaccgccagtccgctagtcggacatacaacatacacgaccgaaggaacggaaccgggtcccctacggttacttgagtaggaacgtactttaaagtaggtagagtcggaccctacccgtacgaaaccggaaggggacgaccggtacctccccgtagtacgtccgtcttccgcgacggtcctacgacgtcctcggggngggtctgacgcgcctaccncacctactcctccgacgtcccctacgacgtcgtaggacggtagtacgggacggtacttacgtaactttaacgttacgtcgtacggtaaacgggtcggggtcgggtaacctacggttcgggtttaccggggttttaggggtacggttacgggggacggggtaacgggaaccgtaacggtcgtaacggtacccggttacgtacggaccaccggacccgtacggtcccg

SEQ ID NO: 315970 - DNA, 568 bp, Homo sapiens
  misc_feature: GZ8MTXP02GFT2W.38.7.A07.1.454.CMB.2.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaangtgatggcaccctnaccgaagggagacgggatcccgtgacctcgcttctcaggcctcngctcgnggggctggacgccgctacctcacccactcctcccgacgccctcctagtcctaggacgtatggacggtctggtacttattacgtgtacgacggtacgggtggggactacgttgggtccggtttggggtacgttccggggacgggtacgggaccgaacggtccgtacggacccgttacgtaacgggtaccgacggtaccccgaacgggccttccggacccccgtttcgg

SEQ ID NO: 315971 - DNA, 759 bp, Homo sapiens
  misc_feature: GZ8MTXP02FUOOQ.38.7.A07.1.454.CMB.2.raw
  modified_base (532)..(532): a, c, t, g, unknown or other
  misc_feature (532)..(532): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtggcacgagcagcaacgccatcgcagtggcatcaacatcagcagaggaacggcctacggtactgatagaatcttaagtagtgagtcggacccaccccgtacgaaaccggaaaggggacggaaccggggtactccccgtaggtaaccttcccggtccttaccgtacggaacgggtccccttacccggacggtcccgttccggggtacgggggtccttacggggaaccggttccccgggtaccctttaaacccccgttaccgaaacccccgttaacgttccccctacccgaaccgtccccctaccggtaacgttcggtagggaaacggtnttacgggaacggtcttaggtaactttagttaccgtggtaaaccggaggggtaccgggtggggtaccgttacggttccggggtttacggggtttaggggtaccgggttaccgggggaaacggggtaacgggtaaaccgtacggttaccggtaaccggtacccgggttacggtaacggtacccgaacggtaccccggtacggtccccggtacccggtacccccgttacg

SEQ ID NO: 315972 - DNA, 562 bp, Homo sapiens
  misc_feature: GZ8MTXP02IZDWN.38.7.A07.1.454.CMB.2.raw
  modified_base (347)..(347): a, c, t, g, unknown or other
  misc_feature (347)..(347): n is a, c, g, or t
tcagtcgatcacgtcacgaccggtgctcgatttagcacgtgtcgcaggggagatctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggcccctcggtacttgatgaagtcttaaataggtgatgggccaccctcaaccgaaggggacgacgggactcccctgactcgcttctcgnggcctcacgctcgtggggctgacgcgcctacctcacctatcctccacgccctcagtctggaggatgaggtctagactattacgtgtacaggtacggtggggactacggttacggtccgggttttaggggtacgtttccgggggacgggtacgggggaacctaacggcgtccggtaacccggtcgtacggtaccggacgacccggaacggtccccg

SEQ ID NO: 315973 - DNA, 516 bp, Homo sapiens
  misc_feature: GZ8MTXP02H85JH.38.7.A07.1.454.CMB.2.raw
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (406)..(406): a, c, t, g, unknown or other
  misc_feature (406)..(406): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagcagagaggccctcggtacttgatgaagcttaatagtgatggcacctcaaccgaaggggagacggactccctgactcgcttcncnggctcagctcgtggggctgacgcgctacctcaccatcctcacgcctccagtctgagatggagctgactatacngtcagacgtgggcacgtgtccggtttgggtacgttcggggcggaacgggacccgtaaggccgttaacggacccggttaccgtacggtccgacggccccgaaaggtccccg

SEQ ID NO: 315974 - DNA, 596 bp, Homo sapiens
  misc_feature: GZ8MTXP02IFWX3.38.7.A07.1.454.CMB.2.raw
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacntcagccagaggaacggccctggtacttgatgaagtcttaaatagtgagtggaccaccccgtcaaccgaaggggagaccggggatcccgtgacctcgcttcncgacggcctccgngtcctcgtcgggggctggacgcgcctaccctcaccctactcctacccacgtccctccgagtcgtggaggagtaggacggtctagtacttattacgtgtaccgaggtacggtggggactacgttcggtccgggtttagggtacgttcggggcgggtaacgggaaccgaacggtccgtacggtacccgtaccgtaacgggtaccgaacggacccgaacggtcccgtaccggtacccccgtccgg

SEQ ID NO: 315975 - DNA, 552 bp, Homo sapiens
  misc_feature: GZ8MTXP02HK9N8.38.7.A07.1.454.CMB.2.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtggcacagcagcaacgccatcgcatggcatcaacatcagccagagaacgggccctcggtacttgatgaagcttaatagngatggcacctcaaccgaagggagacggactccctgactcgcttctcnggctcagtctcgtggggctgacgcgctacctcaccactcctccacgccctccgacgtcgtacggaggactggagtctagtacttaacgttactcgtcgacggacggtggggactacggtcggttccgggtttgggtacggttcggggacgggtacgggtaccgaacggtcgtcggtaccggtcgtacggtaccgaccggacccggaacggtcccgg

SEQ ID NO: 315976 - DNA, 549 bp, Homo sapiens
  misc_feature: GZ8MTXP02JLHRO.38.7.A07.1.454.CMB.2.raw
  modified_base (347)..(347): a, c, t, g, unknown or other
  misc_feature (347)..(347): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctacggtacttgatagaagcttaagtagtgatcgggccaccctacgaaccgaaggggacgacggactccctagactcgcttctcnggctcagctcgtggggctgacgcgactacctcacctactcctccacgtccctccacgtctaggaggtatggacggtctaggtacttacgttacgtacggtacgacggtacgggtcggggcacggttcggtaccgggtttgggtacgttcggggacgggacggtaccgagcgtcgacgtcgtacggcgacgccgacggtcccg

SEQ ID NO: 315977 - DNA, 506 bp, Homo sapiens
  misc_feature: GZ8MTXP02HVAH4.38.7.A07.1.454.CMB.2.raw
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgccatcgcatggcatcaacatcagccagagaagggccctggtacttgatgaagcttaaatagtgatggcacctnaaccaaggggagacgggactccctgactcgcttcncnggctcagctcgnggggctgagcgctactcaccatctccagccctccagtctgaggatgaggctgaactattactgtcaggacgtggggcacgtcggtccggtttgggacttcgggcggacggggtaccaaggcgtggacccgtccgtaggtccaacggcccgaaggtcccg

SEQ ID NO: 315978 - DNA, 546 bp, Homo sapiens
  misc_feature: GZ8MTXP02FTVFK.38.7.A07.1.454.CMB.2.raw
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggcccctggtacttgatgaagcttaatagtgatgggcaccctcaccgaagggagacgggactcccgtgatcgcttcncnggctcagctcgtggggctgagcgctacctcacctatcctccacgccctcagtctagacgatggagctagaacttacttacgtgtcgaaggacggtgggggactacggttcggtccggttttaggggtacgttcggggacgggtacgggaaccgaaggtccgtaacggtacccgtaccggttacggaccgaacggacccgaaggtccccg

SEQ ID NO: 315979 - DNA, 579 bp, Homo sapiens
  misc_feature: GZ8MTXP02IHD24.38.7.A07.1.454.CMB.2.raw
  modified_base (331)..(331): a, c, t, g, unknown or other
  misc_feature (331)..(331): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgccatcgcatggcatcaacatcagccagagaaggcctcggtacttgatgaagcttaaatgtgatggcaccctacaccgaaggagacggatcctgactcgcttctcaggctccngtctcgtgggggctgagcgactacctcacctatctccacgcctccagtctacgaggtatggacggctagtaacttagtttacgtacgttacgacggtacggtcgggggtactacgttcggtaccggttttaggggtaacgtttcggggacggggtaacgggaccgtaaacggtccgttacggacccgttacgtaacgggtaccgaacggtaccccgaaaagggtcccgtaccggtcccccgttaccgg

SEQ ID NO: 315980 - DNA, 527 bp, Homo sapiens
  misc_feature: GZ8MTXP02ITXDX.38.7.A07.1.454.CMB.2.raw
  modified_base (338)..(338): a, c, t, g, unknown or other
  misc_feature (338)..(338): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggcccctcggtacttgatgaagcttaatagtgatggcaccctcaaccaaggggagacgggactcccgtgatcgacttctcnggcctcagctcgtggggctgagcgctacctcacatctccacgccctccagtctagacggatgaggctgactattttacgngtcagggggactggggacncgtggtccgtttagggtacgttcgggcgggtacgggaccgaagcgtaacggacccgtacggtacggtaccgacggacccgaacggtcccg

SEQ ID NO: 315981 - DNA, 537 bp, Homo sapiens
  misc_feature: GZ8MTXP02GAAQD.38.7.A07.1.454.CMB.2.raw
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatagaagtacttaatagtgagtcggcaccctacaaccgaagggacgacgggactcccgtgatcgcttcncgnggctcgagctcgtgggctgacgcgactacctcacctatccnccagccctacgagtctaggaggatggaggctagacttagttacgtgtcgaggtacggtggggctacgtcggtacggtttgggtacgttcgggacggacgggaccgtaggcgtaacggtaccgtcgtacggtcgacggaccgaacggtcccg

SEQ ID NO: 315982 - DNA, 546 bp, Homo sapiens
  misc_feature: GZ8MTXP02GBL4O.38.7.A07.1.454.CMB.2.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctcggtacttgatgaagcttaaatagtgatggccacccctnaccgaaggggagacgggatccctgactcgcttcncaggcctcngctcgtggggctgacgcgctacctcaccactcctccacgccctccagtctgaggtatggaggctaggacttattacgtgtacgaaggtcggtgggcacgttcggtccggtttggggtacgttccggggacgggacgggacccaaggtccgtcggaacccgttccgtaaggtccacggacccgaaggtccgtccggcccccgttcgg

SEQ ID NO: 315983 - DNA, 562 bp, Homo sapiens
  misc_feature: GZ8MTXP02ILTF8.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaatagtgatggcaccctcaccgaagggagacgggactcccgtgactcgtcttctcagggtctccagtctcgtggggctgagcgctacctcaccatcctccacgtccctaccagtctagacggatggacggctacgactagttactgtacgacggtacggtggggactacgttcggtaccggtttcggggtacggtttaccggggacggggtacgggaaccgtaacggtccgtaacggtacccgttacgtacgggtaccgaccggtacccgaacggtccccg

SEQ ID NO: 315984 - DNA, 550 bp, Homo sapiens
  misc_feature: GZ8MTXP02H9R0Q.38.7.A07.1.454.CMB.2.raw
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaaatagtgatggccaccctcaccgaagggagacgggactccctgactcgcttctcagctcngctcgtggggctgacgcgcctacctcaccactcctccacgcctccagtctgagatggaggcgtgtacttattacgtgttcgagtacggtggggacgtacgtcggtcggtttcgggtaacgttcggggacgggtacgggaaccgaacggtcgtacggtacccgtacgtaacggtcgaacggcccgaaacggtcccgtaccggtcccccgtccgg

SEQ ID NO: 315985 - DNA, 624 bp, Homo sapiens
  misc_feature: GZ8MTXP02F3O46.38.7.A07.1.454.CMB.2.raw
  modified_base (510)..(510): a, c, t, g, unknown or other
  misc_feature (510)..(510): n is a, c, g, or t
  modified_base (606)..(606): a, c, t, g, unknown or other
  misc_feature (606)..(606): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccactcgcagtggacactacaacactacgacgaccgaaggaacggaaccggtcccgttacggtacgttagagtagaacgtacttaaagtagtagacgtcgacctacctacgaaacggaagggacggacggactccgtagacctcgtcttacgacgacgcctacgcgtctcgggtcgggctacgacgccgtaccctaacctccaaactcttcccgaccgcgtcccctagtacgttgagggaagtgaacgggtctactacgtaactttacttcggagaccgaggggttcggngggtaaccttcggtccggtttaggggtttacggtcgtaccgggggagggtaacgaaccagtcgtaacccggaccgtttagaagccgaccgtaccgngtcctcccggcctttacg

SEQ ID NO: 315986 - DNA, 588 bp, Homo sapiens
  misc_feature: GZ8MTXP02HKI8P.38.7.A07.1.454.CMB.2.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaacggccctggtactgatgaagtcttaanagtgatcggccaaccctcgaaccgaagggagacgggactcccgtagacctcgcttcncgaggctcgngctcgnggggctggacgcgtctacctcaccactcctccacgtccctaccagtcgtaggaggtagtaggacggcgtacgtacttagttacgtgtacgaggtacgggtcggggactacggttcggtccgggtttaggggtacggttacggggacgggtaacgggaaccgtaacggtccgtacggtacccgtaccggtaacggtcgaaccggacccgaacggtcccgtacccggtcccccgtccgg

SEQ ID NO: 315987 - DNA, 532 bp, Homo sapiens
  misc_feature: GZ8MTXP02GLOCL.38.7.A07.1.454.CMB.2.raw
  modified_base (283)..(283): a, c, t, g, unknown or other
  misc_feature (283)..(283): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaanagtgatggccacccgtacaaccgaagggagacgggactcccngactcgcttcncgnggcctcagctcgtggggctgacgcgactacctcaccatcctccagccctacagtctggagatggaggctagactattactgtcgaggcggtggggctacgtcggtccggtttagggtacgttcggggacgggtacggaccgaaggccgtaacggtacccgtacgtacggtaccgacggacccgaaggtccccg

SEQ ID NO: 315988 - DNA, 554 bp, Homo sapiens
  misc_feature: GZ8MTXP02G61RW.38.7.A07.1.454.CMB.2.raw
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaatgtgatggccaccctcaaccgaagggagacgggactcccgtgactcgcttcncgaggctcngctcgtggggctgacgcgctacctcaccatctccacgcctccagtccgtaggacgatggagtctagtacttattacgtgtcgaaggtcggtggggactacgtcggtccggtttagggtacgttcggggacggaacgggtaacccgaaggtccgtacgtacccggtacgtaacggtacgaccggtcccgaaacggtcctcccggtaccccgttccgg

SEQ ID NO: 315989 - DNA, 594 bp, Homo sapiens
  misc_feature: GZ8MTXP02GTETS.38.7.A07.1.454.CMB.2.raw
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgccatcgcatggcatcaacatcagccagagaacggccctcggtactgatgaagcttaanagtgatggccaccctcaaccgaagggagacggactcccgtgactcgcttcncgcggctccagctcgtcggggctggacgccgacctaccctcaccactcctaccacgtccctccgacgtccgtaggacgggtatacgggacggtcgtaggacttaagtttaccgtgtacgagggtaccggttgggggctaacggttcgggtacccggttttagggggtacgttcgggggacggggtacgggtaacccgaaggtccgtaacggtaccccggttacgtacgggtaccgaccggtacccgaacgggtccccg

SEQ ID NO: 315990 - DNA, 561 bp, Homo sapiens
  misc_feature: GZ8MTXP02I2LMQ.38.7.A07.1.454.CMB.2.raw
  modified_base (334)..(334): a, c, t, g, unknown or other
  misc_feature (334)..(334): n is a, c, g, or t
  modified_base (427)..(427): a, c, t, g, unknown or other
  misc_feature (427)..(427): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatagaagcttaatagtgatggcacctcaccgaagggagacggactcctgactcgctctcnggctcacgctcgtgggctgacgcgcctacctcgaccactcctccacgtccctccagtctaggacggtatcggaggctagaacttacgttacgngttcgacggacggtcggggctaacgttcggtcggtttacggggtacgttaccggggacggggtaacgggacccgtaagccggtaacggtaccccggtaccgttacgggaccgaccggacccgaacggtccccgg

SEQ ID NO: 315991 - DNA, 551 bp, Homo sapiens
  misc_feature: GZ8MTXP02IY41M.38.7.A07.1.454.CMB.2.raw
  modified_base (343)..(343): a, c, t, g, unknown or other
  misc_feature (343)..(343): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctacggtactgatgaagcttaatagtgatggaccaccctacaccgaagggacgacgggactccctgactcgtcttctcgaggcctcngtcgtcgtggggctgacgcgtctaccctcaccatcctccacgccctccgagtcgaggacgatcggaggtctaggtacttattacgtgacgaaggtcggtggggacctacggttcggtccggtttgggtacgttcggggacgggtacggacaggtcgtacgaccgttcgtaaggtaccgacggacccgaggcctacccggtcccgtcgg

SEQ ID NO: 315992 - DNA, 723 bp, Homo sapiens
  misc_feature: GZ8MTXP02FUACR.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccagagaacgggccctcggtacttgatagaagtacttaaagtagtagatcgggccaccctacaaccgaaggggacgacgggactcccgtgactccgtcttccgtacgacgggtcctccgaaggtccgttcgggtcgggggcctaggacgcccgtacccttacccgtaccaaccctaacttcccaccctaacggtccccttacccgaacgttccgttagggaaacgggtacgttacgggaacgggtccttaacgggtaacctttaaacgttaacgttcggtaaccgtaacgggtaaccggggtcgggggtacctaacgggttcgggtttccccggggtttttaaggggtaccggtttccgggggaaccggggttaacgggggaaacccgtaacgggtaccgttaaccgggtaaaccccggtttaccggtaaacggggttacccgaaccggtaccccggaaacgggttcccccgg

SEQ ID NO: 315993 - DNA, 570 bp, Homo sapiens
  misc_feature: GZ8MTXP02JYXY6.38.7.A07.1.454.CMB.2.raw
  modified_base (339)..(339): a, c, t, g, unknown or other
  misc_feature (339)..(339): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaaatagtgatggccaccctcaaccgaaggggagacgggactcccgtgactcgcttcncgacggcctcagctcgtggggctgacgcgctacccgtcaccactcctccacgccctaccgagtcctaggaggatggaggctaggtaacttagttaccgtgtacgaggtacggtcggggacctacggttcggtacggggtttaggggtacgtttcgggggacgggtacgggaaccgaaggtccgtaacggtacccggttaccggtacggtccgacggacccgaaggtccccg

SEQ ID NO: 315994 - DNA, 571 bp, Homo sapiens
  misc_feature: GZ8MTXP02JMX63.38.7.A07.1.454.CMB.2.raw
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtcgatcacgtcacgaccggtgctcgatttagcacgtgtcgcaggggctggggagtcagcaccatggcttggaccccactcctcttcctccaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaaanagtgatggccacctcacgagggagacgggatccgtgactcgcttctcgaggtcctcgngtctcgtggggcctggacgcgctacccncaccnctccacnctcctcagtcgtaggagtgtaggacgtctagtacttagttacgtagtacgaggtcgggtggactacggttcggttaccggtttagggtacggttcggggacggggtaacgggaccgtacggtccgtaccggtacccggttacggtaacggtacccggaccggtacggtaccgtcccgtacccccggtccgtccg

SEQ ID NO: 315995 - DNA, 554 bp, Homo sapiens
  misc_feature: GZ8MTXP02J0JA6.38.7.A07.1.454.CMB.2.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagcttaaatagtgatggcaccctcaaccgaagggagacgggactccgtgactcgcttcncaggctcngctcgtggggctgacgcgctacctcacctatcctccagcctccagtctaggagtagtggacggtctaggacttattacgtgtcgaggtacggtggggacacgtggtccggtttgggtacgttcggggacgggaacggggaccaaggtccgtacggacccgttacgtaacgggtaccgacggtcccgaaaggcccgttaccggcccccgttaccgg

SEQ ID NO: 315996 - DNA, 554 bp, Homo sapiens
  misc_feature: GZ8MTXP02IVLYU.38.7.A07.1.454.CMB.2.raw
  modified_base (332)..(332): a, c, t, g, unknown or other
  misc_feature (332)..(332): n is a, c, g, or t
  modified_base (403)..(403): a, c, t, g, unknown or other
  misc_feature (403)..(403): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaggccctggtacttgatgaagcttaatagtgatggcacctcaaccgaagggagacggatcccgtgactcgcttctcnggtctcagcctcgtggggctgagcgcctacctcaccatcctccgacgtccctcctattccgtaggacggtntggaggcttgaacttattacgtgtcgaggtaccggtggggaccacggttcggtccggttttaggggtaacgttccggggacgggtacggggaaccctaaggccgttaacggacccgtcgtaacggtccgaccggtacccgaaacggtcccg

SEQ ID NO: 315997 - DNA, 699 bp, Homo sapiens
  misc_feature: GZ8MTXP02GYGNY.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacgggccctacggtacttgatagaagtcttaaatagtgaatcgggaccaccctcaaccgaagggacgacgggactcccgtagactcgcttcgtcgacggctccgagtccgtcggtcggggctggacgtccggtacctaccctacacccacttcctacccgacggtcccctacccgacgtccgttacggaagggtacgttacgggacgggtaccttacggtaaacctttaacgttaaacgttcgggttaccgaaacggggtaccggggttcgggggacctaaccggtttcggggttaacccggggtttttgggggttaaaccggtttccggggggaacggggttaaccgggggaaaccggtaacggggtacccgttcggggtaaccccggtttaccgggtaccgggttaccgaaccgggtaccccgaaacggggtcccccgg

SEQ ID NO: 315998 - DNA, 607 bp, Homo sapiens
  misc_feature: GZ8MTXP02JWEK0.38.7.A07.1.454.CMB.2.raw
  modified_base (178)..(178): a, c, t, g, unknown or other
  misc_feature (178)..(178): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgccatcgcatggcatcaacatcagccagacgaacggccctaggtacttgatgaagcttaaangtgagtcggaccacctcgaaccgaaggggacgacgggacctcccgngactccgctttcncgacggcctccgagccgtcggtgggggctggacgcgtcctaccctcaccactcctccacgccctaccgacgtccgtaggacggtaacgtcggacggtacgtcggtaaacttacgttaaccgtggtacgtaacgggtacggttcgggggacctaacggttcgggttaccgggtttaggggttacgttaccgggggacgggtaacgggtaccgaacggtcgtaacggtacccgtacgtacggtcgaccggtaccgaggtccccg

SEQ ID NO: 315999 - DNA, 557 bp, Homo sapiens
  misc_feature: GZ8MTXP02F69O1.38.7.A07.1.454.CMB.2.raw
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacccgcactctgagcagtgggcacagcagcaacgccatcgcatggcatcaacatcagccagagaagggccctggtacttgatgaagcttaaatagtgatggcacccctnaaccgaagggagacgggatcccgtgactccgcttcncaggctccagctcgtggggctgagcgctacctcaccatctccagccctccagtctgagatgaggctgactatactgtcagacggtggggcacgtgtccggtttgggtacgttcggggacgggacggggaccgaaaggtccgtacggtaacccggtccgttaacgggtccgaacggtaccccgaaaacgggggtccctaccggtaccccccgtacgggttacccccg

SEQ ID NO: 316000 - DNA, 595 bp, Homo sapiens
  misc_feature: GZ8MTXP02JOJ9F.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccaccgcatggcatcaacatcagccagagaacggccctcggtacttgatgaagcttaatagtgatggcaccctcaaccgaaggggagacgggactcccgtagactcccgcttctcgacggcctccgagctccgtgggggctggacgccgctacctccaccactcctccacgccctacagtctgaggatggaggctgactattacgtgtacgaacggtacgggtcgggggacctacggttcgggtcccgggttttagggggtacgtttccgggggacggggtaacggggaacccgaggtccggtacggtaacccgttccgtaagggtccgaaccggacccgtacggggccctacccggtcccccgtagggtccccg

SEQ ID NO: 316001 - DNA, 536 bp, Homo sapiens
  misc_feature: GZ8MTXP02GGOVH.38.7.A07.1.454.CMB.2.raw
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaaagcttaatagtgatgggacaccctcaaccgaagggagacggactcccgtgatcgcttcncngctcgagctcgnggggctgancgctaccncacatccncagccctcagtctaggacgtatggagtctagacttacgtacgtgtcgagacggtcggggctacgtcggtccggttttggggtacgttcggggacgggtacgggaacccaaggtcgtcggaacccggttcgtacgggtaccacggaccccgaaggtccccg

SEQ ID NO: 316002 - DNA, 581 bp, Homo sapiens
  misc_feature: GZ8MTXP02HY1RR.38.7.A07.1.454.CMB.2.raw
  modified_base (277)..(277): a, c, t, g, unknown or other
  misc_feature (277)..(277): n is a, c, g, or t
  modified_base (335)..(335): a, c, t, g, unknown or other
  misc_feature (335)..(335): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtactgatgaagcttaanagtgatggccaccctcgaaccgaagggagacgggactcctgactcgcttctcagctcngctcgtcggggctggacgcgcctacctcaccactcctccacgtccctccgagtcgtagacggagtaggacggtactagtaactttagttaccgtgtacgacggtacgggttcggggactaccggttcggtccggtttacggggttacgttccggggtacgggtacgggaaccgtaaacggtccgtacggtacccggtacgtaacggtcgaaccgacccggaacggcccgtccggtacccccgtcgg

SEQ ID NO: 316003 - DNA, 583 bp, Homo sapiens
  misc_feature: GZ8MTXP02H6RP5.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcaaacaacgccatcgcatggcatcaacatcagccagagaacgggccctaggtacttgatgaagtcttaaagtagtgagtcggacctacccgtacaaccgaaaggggacgaacgggactcccgagactccgcttctcgacggctaccgagtcgtcgtggggctgacgcgacctaccctcccgacactccctaccacgccctaccagttctaggacggtactaggacgtcttaggtaacttagttacgtgtacgaggtacggtggggactacgtcggtcggttagggtacgttcgggacggtacggacaacggcgtacgtaccgtacgtacggcgacggaccgaacggtcctacccggtccccgtacggtccc

SEQ ID NO: 316004 - DNA, 517 bp, Homo sapiens
  misc_feature: GZ8MTXP02FOZI5.38.7.A07.1.454.CMB.2.raw
  modified_base (336)..(336): a, c, t, g, unknown or other
  misc_feature (336)..(336): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaatagtgatggccaccctcaaccgaagggagacgggatcccgtgactcgcttctcaggctcngctcgtggggctgagcgctacctcaccatctccacgccctccagtctgagatggaggctgactattactgtcgagacggtggggcagtcgtcggtttgggtacgttcggggaggacggggaccaaggccgttacggaccgtccgtaaggtccacggacccgaaggcctcggcccccttcgg

SEQ ID NO: 316005 - DNA, 618 bp, Homo sapiens
  misc_feature: GZ8MTXP02H9IPY.38.7.A07.1.454.CMB.2.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (344)..(344): a, c, t, g, unknown or other
  misc_feature (344)..(344): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacancagccagagaacggccctcggtacttgatagaagcttaanagtgatggccaccctcgaaccgaagggagacgggactccgtgacctcgcttctcgacggctccngcgtcggtcggggctgacgccgcctaccctcaccctatcctccacgtcccttaccgagtccgtaggacggagttggacggtctacgtaactttaagttacgtagttaccgaggtacgggttcgggggacctacggtcgggttcccgggttttaggggtacggttcggggacggggtaacgggacccgtaaagggtccgtacggtaccccggtacggttaacgggtacccgacggtaccccggaacgggtcccgtaccggtccccccgttccggg

SEQ ID NO: 316006 - DNA, 610 bp, Homo sapiens
  misc_feature: GZ8MTXP02ITOI8.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcacgccaagacggaacgggccctacggtacttgatagaagtacttaatagtgagtcggacctacccgtacgaaccgaagggacgacgggactcccgtagactccgtcttccgtacgacgggtcctaccgacgtccgttcgggtggggctggacgcgtacctaccctccacctatccgtacccacgtccctacgacgtcgtaggaggtatggagtctaggtaactattacgtgtacgaaggtcgggtcgggactacggttcgggtccggttttaggggtacgttcgggggacgggtaacgggtaccgtaaggtccgtaacggacccgttacggtacggtaccgaccggaccgtaacggtccccg

SEQ ID NO: 316007 - DNA, 566 bp, Homo sapiens
  misc_feature: GZ8MTXP02JPW45.38.7.A07.1.454.CMB.2.raw
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggcacagcagcaacgccatcgcatggcatcaacatcagccagagaacggccctggtactgatgaagcttaatagtgatggccaccctcaaccgaaggggacgacgggactcccgtgactcgcttcncgngctcagctcgtggggctgacgcgctacctcactactccnccacgtccctacgtacgtcgtaggaggtagtcggtacggtctacgtaacttacgttacgtacggtacgacggtacgggtcgggactacggtcggttacggtttagggtacggtcggggacgggtacgggaccgtacggtcgtaaccggtaccggtacgtacggtaccgaccggtaccgacggtcccg

SEQ ID NO: 316008 - DNA, 554 bp, Homo sapiens
  misc_feature: GZ8MTXP02HN0WF.38.7.A07.1.454.CMB.2.raw
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacgggccctaggtacttgatgaagtcttaaagtagtgatgggaccaaccctcgaaaccgaaaggggacgacggggtactccccgtagactcgactttcncnggcctcagctcgtggggctgacgcgctacctcaccactctccacgccctccagtctggacggatggagctagtactattacgtgtacgaggacggtgggacgtacgtcggtccggtttaggggtacgttcggggcgggacgggaccgaacggccgtaacggaccgtccgtacggtccgacggacccgtaacggtcccg

SEQ ID NO: 316009 - DNA, 570 bp, Homo sapiens
  misc_feature: GZ8MTXP02F0HY3.38.7.A07.1.454.CMB.2.raw
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcacgtggcacagcagcaacgccatcgcatggcatcaacatcagccagagaacggccctggtacttgatgaagtcttaaatagtgagtggccaccctacaccgaagggacgacgggatcccgtgactcgcttactcgacggctccgngctcgtggggcctgagcgccttaacccncacctactccaccncgtccacgagtcgagagagtcggacgtctacgtacttattacgtgtacgacggtacggtcgggtactacgtcgggttcggtttagggtacggttcgggacgggtacggaaccgtacggtccgtacggtaccgtacgtaacggtcgaaccggtaccgacggtcccgtacccggtccccgtacg

SEQ ID NO: 316010 - DNA, 535 bp, Homo sapiens
  misc_feature: GZ8MTXP02JMN54.38.7.A07.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaanagtgatggcacctcaccaaggganacggatccctgatcgcttcncngcncngctcgtggcgngagcgctacctacaccactactccacgcctccacgtacgtagaggagtagagacgtacgtactaacgttactacgtacgacgtacggtagggacgacgtacggtcggtttacgggttacggttacgggtacgggacgggaccgaacgacgtaacgtaccgtaccgtacggtacgacgaccgaacggacg

SEQ ID NO: 316011 - DNA, 555 bp, Homo sapiens
  misc_feature: GZ8MTXP02H7ZH4.38.7.A07.1.454.CMB.2.raw
  modified_base (239)..(239): a, c, t, g, unknown or other
  misc_feature (239)..(239): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaaggccctggtactgatgaatcttaangtgatgcaccctnacgaagggagacgggactcccgagactcgtaccttcacgtaggcctcccgagtccgtcgcgggggtctgacggcncctacctcaccatcctacacgcctcagtctggagatagnggtactagtacttatacgtgtcgaggtacggtggggctacgtcggtccggtttgggtacgtacggggtcggaacggtaccgaaacggtccgtacggtacccggtacgtaacggtccaacggtcccgaaggtcccgtacccgtaccccgtcgg

SEQ ID NO: 316012 - DNA, 672 bp, Homo sapiens
  misc_feature: GZ8MTXP02H4BJ2.38.7.A07.1.454.CMB.2.raw
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcactgcactctgagcagtgggcacagcagcaacgccatcgcatggcatcaacatcagccagagaacggccctacggtactgatagaaagtctttaaatagtgatcggccaccctcaaccgaagggagacggggactccgtgactcgcttcncgagctccngtcgtcgtcgggggctggacgcgtacctacccgtccaaccctactcctacccacgtcccttaccgagtcctaggacggtatgggacggtcgttacggtaacttaacgttacgtacggtacgtaacgggtaccggttcgggggaccttacgggttcgggttaccggggtttttacgggggttaacggtttccgggggtaccgggggtaacggggaaaccccggtaaagggtcccgtacgggtaaacccccggttccgttaaacggggtacccgaaacggggacccccgaaacggggtccccgttacccgggtacccccgtttcccggg

SEQ ID NO: 316013 - DNA, 560 bp, Homo sapiens
  misc_feature: GZ8MTXP02GLZYQ.38.7.A07.1.454.CMB.2.raw
  modified_base (360)..(360): a, c, t, g, unknown or other
  misc_feature (360)..(360): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaaatagtgaatgggcacctcaaccaagggagacgggactcccgtgatcgcttctcacggctccgagcctcgtgggggcngacgcgctacctacacactctccacgtcctcctacgtcgtaggtaggtagtaggacgtacgtacgtacgtaacgttacgtacgtacgtacggtacgggtacgggtcgtacgtcggttcggtttacgggttacggttacgggtacgggacgggacgaacgacgtaacgtaccgtaccgtacggtacgacgaccgacggtcg

SEQ ID NO: 316014 - DNA, 563 bp, Homo sapiens
  misc_feature: GZ8MTXP02FL8ZF.38.7.A07.1.454.CMB.2.raw
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagcccaaggacgaaagggcccctaggtacttgatgaagtcttaanagtgatggcaccctcaccgaagggacgacgggacctcccgngactcgcttcncgcggcctcagtcctcgtggggctggacgccgacctacccgtcacctcgtccnccgacgtccctcgagtcctaggacgngtcggagtctaggtacttacgttacgtgtacgaaggtcggtggggacctacggttcggtcggtttaggggtacgttcgggacggtacgggacacggtacgtcggtaacccgtcgtacgtacgaccgaccgaacgggtccc

SEQ ID NO: 316015 - DNA, 526 bp, Homo sapiens
  misc_feature: GZ8MTXP02JOEPV.38.7.A07.1.454.CMB.2.raw
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaaatagtgatggaccaccctcgaaccgaagggacgacgggatccctagactcgcttcncgaggctcngctgnggggctgacgcgctacctcaccatcctcacgcctcagtctgacgatggaggtctgactattacgngtacgaggcggtggggctacgtggtccgtttgggtacgttcggggacggacggggaccaaggcgtacgaccgtcgtaacggtcacggccgaacggcctaccggccccgtcgg

SEQ ID NO: 316016 - DNA, 588 bp, Homo sapiens
  misc_feature: GZ8MTXP02JWXNG.38.7.A07.1.454.CMB.2.raw
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacggcctggtactgatgaagctaatgtgatggcacctcaaccgaagggacgacgggactccgtagactcgcttcncgnggcctccagtctcggtcgggggtctggacgccgtacctaccctcaccctactccctaccacgtccctcgacgtccgtaggaggtagtggacggtctaggtaacttagttaacgtcggtacgacggtacgggtcggggtactacggttcgggttcccgggtttaggggtacggttcggggacggggtaacgggaccgtaacggcgtaacggacccggttaccgtacggtaccgacggtaccccgaaggggtccccg

SEQ ID NO: 316017 - DNA, 601 bp, Homo sapiens
  misc_feature: GZ8MTXP02HVTOK.38.7.A07.1.454.CMB.2.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagtcttaatagtgatggcacctcaccgaagggagacgggactccgtgactcgcttcncgaggcctcngctcgtgggctgacgcgctacctcacctatcctcccacgtccctccgacgttccgtggacgggtatgggtacggggcttaggtaacttaattaaccgttgtacgaacggtacgggttagggggcctacgtcggtacccgggttttgggggtaacgtttccggggacggggacgggtaacccgaaacggtccgtacggtaccccgttacgtaacgggtccgaaacggtccccgaaagggtcccttccggccccccgtttccggg

SEQ ID NO: 316018 - DNA, 555 bp, Homo sapiens
  misc_feature: GZ8MTXP02FRLV3.38.7.A07.1.454.CMB.2.raw
  modified_base (349)..(349): a, c, t, g, unknown or other
  misc_feature (349)..(349): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagaggaacggccctcggtacttgatgaagcttaatagtgatggcacccctcaaccgaaggggacgacgggactcccgtgactcgtcttctacgaggcctccgngcctacggtggggctggacgcgcctacctcacccatcctccacgccctccagtctggagntggagtctgacttattacgngtacgaggacggtggggctagtcggtcgggtttgggtacgttcggggacgggacggtaacccaaggtccgtacggaccgttaccgaaggtaccgacgacccgacgggtcctccggcccccgttcgg

SEQ ID NO: 316019 - DNA, 742 bp, Homo sapiens
  misc_feature: GZ8MTXP02JYUQK.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctaggtacttgactgaaagtctttaaagtaggttgaacgtcgggacctaaccccgtacgaaacccgaaagggggacgaaccggggaacctccccgtagtaacttccggtctttaccgtcgacggggtccctacccggtaacggtcccgttccgggtcggggggtccttaggggaacccggtcccggtacccgttaacccccttacccgaaacccctaacgttcccctaccccgaaccggtcccccttacccgaacgttccgtagggaacgggtaacgttcgggaacgggtcttaacggtaacctttaagtttaccggttacggtacgaacgggtaccggggttgggggaccttaacggttccggggttccggttttagggggtaaccgtttccgggggacgggtaacggggaacccgaacggtccgtaacgggtaacccgttccggtaacgggtccaccggtacccggaacggtccccg

SEQ ID NO: 316020 - DNA, 548 bp, Homo sapiens
  misc_feature: GZ8MTXP02HJTC6.38.7.A07.1.454.CMB.2.raw
  modified_base (326)..(326): a, c, t, g, unknown or other
  misc_feature (326)..(326): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaatagtgatggcaccctcaccaagggagacgggatcccgtgactcgactttcncgaggtcctccgagtcctcgtcgggggctggacgcgccttaccctcaccctatcctcccacgtccctccacgtctgagactggaggctgactattacgtgtaccaggacggtggggactacgtgtaccggtttgggtacgttcggggacggtacggggaccaaggtctacggacccgtacgtaacggtcgacgacccgaacggccttaccggcccccgtcgg

SEQ ID NO: 316021 - DNA, 710 bp, Homo sapiens
  misc_feature: GZ8MTXP02HI7VW.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctccagcttgtgctgactcaatccgccctctgcctctgccctcccgtgggacgcctcggtcacgctcacctgcactctgagcaggtggcacagcagacaacgccatcgcagtggcatacaacatcacgccaagacggaacggccctacggttactgactagaaagtacttaaagtaggtagagtcggaccctaacccgtacgaaaccggaaaggggacggacgggacctcccgtagacgttccggtctttaccgtacgacgggtcccttacgacgttccgttcggggtcgggggacttcgggacgtccgtaccctacccgtccaaccctactcctacccgactcccgtaccgtacgtccgtaggaacggtacgtacggtacggtacgttacggtaaccttaacgtttaccgttacggtacggtaacgggtaaccgggttcgggggtacgttacggttacgggttccggggttttacgggggttacgttccgggggtaacgggacggggtaaccgtaacggtccggttaaccggtacccggtacggttacggtaccgaaccggtacccggtaacggtccccgg

SEQ ID NO: 316022 - DNA, 636 bp, Homo sapiens
  misc_feature: GZ8MTXP02HBA23.38.7.A07.1.454.CMB.2.raw
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacntcagccagagaacgggcctaggtacttgatgaaagtcttaaanagtgaatcgggaccaccctcgaaccgaaaggggacgacggggaacctcccgtagaactccgctttccgcacggggccttaccgagtccttcggtcgggggcttggaacgccgccttaaccctcaacctactccgtacccacgtccctacgacgtcctaggacggtagtcggaaggtcctaggtaacctttaacgttaaccgttcggtaccgaacgggtaccgggtcgggggtacctaacggttgggtaccccggttttggggtaacgttccgggggacgggtaacgggaaccgtacggtcgtaacggtacccgtacgtacggtaccgacggacccgtaaggtcccccgg

SEQ ID NO: 316023 - DNA, 588 bp, Homo sapiens
  misc_feature: GZ8MTXP02GSYW9.38.7.A07.1.454.CMB.2.raw
  modified_base (240)..(240): a, c, t, g, unknown or other
  misc_feature (240)..(240): n is a, c, g, or t
  modified_base (366)..(366): a, c, t, g, unknown or other
  misc_feature (366)..(366): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgccctcccgtgggagcctcggtcacgctcacctgcactctgagcagtgggcacagcagcaacgcatcgcatggcatcaacntcagccaagaggaacggccctaggtactgatagaagtcttaaagtagtgatcggaccaccccgtacgaaccgaaggggacgaccgggactcccgtagacctccgtacttcgacgaggtcctaccgngtcctcggtcgggggccttagggacgtccgaccttaccctcaaccctactccctcccacgtccctacgacgttaccgaggagaagtggaacggtctacgtacttattacgtgtaccgaggtacggtggactacgtcggtacggttggtacgtcgggacggtacggaccgagtcgtacgtccgtacgtaacggcacggaccgaggtcctccggtccccgtcgg

SEQ ID NO: 316024 - DNA, 541 bp, Homo sapiens
  misc_feature: GZ8MTXP02FODRS.38.7.A07.1.454.CMB.2.raw
  modified_base (238)..(238): a, c, t, g, unknown or other
  misc_feature (238)..(238): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaanatcagccagagaagggccctggtacttgatagaagtcttaatagtgatcggcacccctcaaccgaaggggagacggggatcccctgactccgtctctcaggcctcngctcgtggggctgagcgctacctcaccactctccagcccncagtcgtgagntggacggctcgacttattaccgtgtaccgaggtacggtcggggcacgtggtcccgggtttgggtaacgttcggggcggacgggaccgaacgcgtacggaccgtacgtaacggtacgacgaccgaacggtcctccgcccccgtccgg

SEQ ID NO: 316025 - DNA, 725 bp, Homo sapiens
  misc_feature: GZ8MTXP02HB9DN.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgccctccctgggagcctcggtcacgctcacctgcactctgagcagtgggcacagcagcaacgccatcgcagtggcatacaacatcagccagagaacggccctggtactgatgaagtcttaaagtagtgatggaccaccctacgaaaccgaaggggacgacgggactcccgtagacctcgcttacgcgacggccttccgagtccgttcggtgggggcctcgggacgccgaccctaaccctcaaccctatccctaccgacgtcccctaccgaagttccgtagggaaggtacgtagggtacgggtaccttacgggtaaacctttaagtttccggtaacggttacccgaaaaggggtaccggggttcgggggtaccctaacgggtttccgggtttccggggtttttacgggggttaaccggtttccggggggaaccggggtaaaccggggaacccgtaaacgggttcccgtaaaccgggtaccccggtttaccggttaacggggtacccgaaacccgggttacccggaaaccggtccccgttaccccgggtacccccccggtttaccggg

SEQ ID NO: 316026 - DNA, 543 bp, Homo sapiens
  misc_feature: GZ8MTXP02IVGHM.38.7.A07.1.454.CMB.2.raw
  modified_base (177)..(177): a, c, t, g, unknown or other
  misc_feature (177)..(177): n is a, c, g, or t
  modified_base (340)..(340): a, c, t, g, unknown or other
  misc_feature (340)..(340): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgcctctgcctctgcctccctgggancctcggtcacgctcacctgcactctgagcagtgggcacagcagcaacgccatcgcatggcatcaacatcagccagagaacgggcccctcggtacttgatgaagtcttaatgtgatggccacctacaaccgaggggagacgggactcccgtgactcgcttctcnggctccgagctcgtggggctgagcgctacctcaccactctccacgtccctcagtctaggaggtatggacgcttagaccttagttaccgtgtacgaggacggtggggctacgtcggtccggtttagggtacgttcggggacggacgggaccgacggtcgtaacggtacccggtacgtacggccgtaacggcccgacggtccccg

SEQ ID NO: 316027 - DNA, 534 bp, Homo sapiens
  misc_feature: GZ8MTXP02FY1EP.38.7.A07.1.454.CMB.2.raw
  modified_base (343)..(343): a, c, t, g, unknown or other
  misc_feature (343)..(343): n is a, c, g, or t
  modified_base (408)..(408): a, c, t, g, unknown or other
  misc_feature (408)..(408): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagtcttaatagtgatggaccacccgtcaaccgaaggggagacgggactccctagatccgtcttccncgacggcctccgagtcctcgtcggggctgacgcgctacctcaccatctccagcctcagtctgagntgagctagactatacgtgacgaggacggtggggactacgtcggtccgtttaggacgttaggttcgggacggggtaacggaccgtaagccgtacggtacccggtcgtacggtacacggaccgaacgg

SEQ ID NO: 316028 - DNA, 549 bp, Homo sapiens
  misc_feature: GZ8MTXP02IDL8R.38.7.A07.1.454.CMB.2.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgccatcgcagtggcatcaaacatcagccaagaggaacgggcccctggtacttgatagaagtcttaaagngtagatggacctacccanaaaccgaaagggcgacggacctcccgtgtactcgtctttcgcgaggccttccacgtcgtcgtcggggcgtcgacgcgctacctccaccactctccacgcctccacgtcagaggagtgagcgtagtactatactagtcgacgacggtggcgtacgtcgtcggttgggtagttcgggtcgggacggacgaacgacgtcggtaccggtaccgtacggtacgacgaccgaacggtcccgg

SEQ ID NO: 316029 - DNA, 662 bp, Homo sapiens
  misc_feature: GZ8MTXP02I6057.38.7.A07.1.454.CMB.2.raw
  modified_base (238)..(239): a, c, t, g, unknown or other
  misc_feature (238)..(239): n is a, c, g, or t
  modified_base (269)..(269): a, c, t, g, unknown or other
  misc_feature (269)..(269): n is a, c, g, or t
  modified_base (339)..(339): a, c, t, g, unknown or other
  misc_feature (339)..(339): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacnncagccagagacggcctcggtactgatgaancttaatagtgatggcaccctcaaccgaagggacgacgggactccgtgactcgcttctcgacggtcctcgngcctcggtggggctggacgccgtacctaccctcaccctagtccctaccgacgtccctaccgagtccgtaggacggagtacggaggtacctaggtaacttattaacgttcgtacgacggggtacggtcgggggtaacctacgggttccgggttacggggttttacggggttaacggtttcccggggggagggaacccgggggaaaccgttaaacgggtcccgttaaccgggtaaccccgggtttaccgttaacggggtaacccgtaaccggggtacccccggaaacggggtccccgttacccgggtacccccccgtttccgggg

SEQ ID NO: 316030 - DNA, 671 bp, Homo sapiens
  misc_feature: GZ8MTXP02HJ8S7.38.7.A07.1.454.CMB.2.raw
  modified_base (352)..(352): a, c, t, g, unknown or other
  misc_feature (352)..(352): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagtctaatagtgatcggaccaccctacaccgaaggggacgacggggtactcccgtgaccgtccgcttctcgacggcctccngtctcggtcgggggctgacgccgcctaccctccaccctactcctacccaccgtccctcccgtacgttcgtaggacgggtaacgtcgggaaggtccgttacggttaacttaacgtttaccgttaggtaccgtaacggggtaccgggtgggggtaccgtaaccggttcgggttccggggttttggggttaacggttccgggggtaccgggggtacgggaacccggtaaacggtcccgtacgggtaaccccggttaccggtaaccggttaccggaccggaccccggtaaacggcccgttcccggtaccccccggttcccggg

SEQ ID NO: 316031 - DNA, 543 bp, Homo sapiens
  misc_feature: GZ8MTXP02G5TRB.38.7.A07.1.454.CMB.2.raw
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
tcagtcgatcacgtcacgaccggtgctcgatttagcacgtgtcgcaggggctggggagtcagcaccatggcttggaccccactcctcttcctcaccctacctcctccactgcacagggtctctctcccagcttgtgctgactcaatcgccctctgcctctgcctccctgggagcctcggtcacgctcacctgcactctgagcagtgggcacagcagcaacgccatcgcatggcatcaantcagccagagaacggcctcggtactgatgaancttaanagtgatggacaccctnacgaagggagacggatccgtgactcgcttcncaggctcngctgnggggctgagcnctacctcaccntccncacgccctcacgtcgtagaggactggacgtcgtgtaaccttagttacgtcgtacgaggtacggtggggctacgtggtccggttggtacgttcggggagggacggaccgaacggtccgtacggaacccgttcggtaacggtaccgacggtacccgaacggtccgtaccggcccccgttcgg

SEQ ID NO: 316032 - DNA, 567 bp, Homo sapiens
  misc_feature: GZ8MTXP02JQTB0.38.7.A07.1.454.CMB.2.raw
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
  modified_base (483)..(483): a, c, t, g, unknown or other
  misc_feature (483)..(483): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtactgatgaagcttaaatagtgatggaccaccctcaaccgaagggagacgggatccccgtgacctcgcttctcgacggcctcngtcctcggtcgggggctggacgccgtcctaaccctcaaccattccnccacgcctccagtctgaggatggaggtctaggtacttattacgtgtacgaggtacggtggggctacgttcggtcggtttgggtacgttcggggngggtaacgggaccgtaaggtccgtacgtacccggtacgtaacggtccgaacggcccgaaggtccgttcccggacccccgttcgg

SEQ ID NO: 316033 - DNA, 546 bp, Homo sapiens
  misc_feature: GZ8MTXP02GVE9I.38.7.A07.1.454.CMB.2.raw
  modified_base (276)..(276): a, c, t, g, unknown or other
  misc_feature (276)..(276): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaanagtgatggcacctcaccgaaggggagacgggatccctgactcgcttctcaggctcngctcgnggggctgacgcgctactcacatcnccagccaccgagtcagagatggagctgactattactgtacaggtacggtggggacacgttcggtccggtttggggtacgttcgggggacgggtaacgggaaccgaaaggtccgtacgggtaccccgttacgtaacgggtccgaacggaccccgaaagggtccctaccggtcccccgtacccggg

SEQ ID NO: 316034 - DNA, 583 bp, Homo sapiens
  misc_feature: GZ8MTXP02F1EN4.38.7.A07.1.454.CMB.2.raw
  modified_base (343)..(343): a, c, t, g, unknown or other
  misc_feature (343)..(343): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccagagaacggccctcggtacttgatgaagcttaatagtgatggccaccctacaccgaaggggagacgggactccgtgactcgcttctcacggcctcgngctcgtgggggctggagcgactaccctcaacctactcctacccacgtccctccgtagttctgggaaggactagggacggtctaggtaacttagtttaaccgtagtaccgaggtacgggtcggggactacgttcggtccggtttagggtacgttcggggacgggtaacgggaccaaggtccgtacggtaccgtcgtaacgggtcaacggaccccgaaggtcccgtccggacccccgttcgg

SEQ ID NO: 316035 - DNA, 566 bp, Homo sapiens
  misc_feature: GZ8MTXP02JJE38.38.7.A07.1.454.CMB.2.raw
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (386)..(386): a, c, t, g, unknown or other
  misc_feature (386)..(386): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctgcctccctgggagcctcggtcacgctcacctgcactctgagcagtgggcacagcagcaacgccatcgcatggcatcaacatcagccagagaacgggccctggtattgatgaagcttaatagtgatggccaccctcgaaccgaaggggagacgggactcccgngactcgtcttcncgnggcctacgagctcggtggggctggacgcgacctaccgtcaccnctcctccgacgtccctccgagttcgtaggagtacgtggacgtctaggtacttagttacgtggtacgacggacgggtgggaccacggttcggttccgggttagggtacgttcggggacggtacggaccgaggtccgtaacggtacccgtacgtacggtcaccggtacccgaacggtccccg

SEQ ID NO: 316036 - DNA, 592 bp, Homo sapiens
  misc_feature: GZ8MTXP02HILLT.38.7.A07.1.454.CMB.2.raw
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagtcgatcacgtcacgaccggtgctcgatttagcacgtgtcgcagggggctgggggagtcagcaccatggcttggaccccactcctcttcctcaccctcctcttccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccaagacgaacggccctggtactgatgaagtcttaanagtgaatcggaccacccgtacaaccgaaggggacgacgggatcccgtagacctcgcttcncaggcctcgngctcgtggggctgacgcnccgtaccncaccatcctaccacgccctacacgtctacggaggtagtggaggctgtaactatttaccgagtacgaggtacgggtcggggactacggttgggtaccgggtttaggggttacgtacgggggacgggtaacgggaacccgtaaaggtccgtacggtacccgtacggtaacgggtccgaacggacccgaagggtcctacccggtcccccgttcccgg

SEQ ID NO: 316037 - DNA, 517 bp, Homo sapiens
  misc_feature: GZ8MTXP02G4VOW.38.7.A07.1.454.CMB.2.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaagtcttaaatagtgatggccaccctcaaccgaaggggacgacgggatcccgtgactcgcttcncaggctcngctcgtggggctgagcgctacctcaccatcctccagccctcacgtctgagatggaggtctagtactattacgtagtcgagacggtgggcagtggtcgttgggtacgttcgggcggacgggacgaacgcgtacgaccgtcgtaacggtcacggccgaaggcctccggcccgtcgg

SEQ ID NO: 316038 - DNA, 521 bp, Homo sapiens
  misc_feature: GZ8MTXP02FSXLI.38.7.A07.1.454.CMB.2.raw
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (394)..(394): a, c, t, g, unknown or other
  misc_feature (394)..(394): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaaccgaagggagacgggatcccgtgactcgcttcncaggctcngctcgtggggctgagcgctacctcaccatctccagcctccagtctgacgatggaggntcgatattactgtcgaggacggtggggcacgtggtccggtttgggtacgttcgggcgggtacgggaccaaggcgtacggaccgtaccgtaagggtccacggcccaacgggctccggccccgttccgg

SEQ ID NO: 316039 - DNA, 559 bp, Homo sapiens
  misc_feature: GZ8MTXP02GD7FG.38.7.A07.1.454.CMB.2.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacagcagcaacgcatcgcatggcatcaacatcagccagagaacggccctaggtacttgatgaagcttaaatagtgatggcaccctcaaccgaagggagacgggatcccgtgactcgacttcncaggcctcgngctcgtggggctgagcgctacctcaccatcctccacgtccctccagtcctgacggntggaggtctacgtacttattacgtgtacaggtacggtcggggacacgtggtccggtttagggtacgttcgggacgggtacgggaaccgaaacggtcgtacggtaccgtaccgtaacggtaccgacggacccgaacggtccgtacccggtcccccttacccgg

SEQ ID NO: 316040 - DNA, 499 bp, Homo sapiens
  misc_feature: GZ8MTXP02FIFRY.38.7.A07.1.454.CMB.2.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagtcgatcacgtcacgaccggtgctcgatttagcacgtgtcgctggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaaatagtgatggaccaccctcaaccgaaagggagacggggactccctgatcgcttctcaggctcagctcgtggggctgagcgctacctcaccatccnccacgcctccagtcnggagatgagctgactatactgtcagacgtgggcacgtgtccgtttggtagtcgggcggacggggaccaagctggacccgtcgtaacggtcacgacccgaaggcccg

SEQ ID NO: 316041 - DNA, 521 bp, Homo sapiens
  misc_feature: GZ8MTXP02H5BGW.38.7.A07.1.454.CMB.2.raw
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacgagcagcaacgccatcgcatggcatcaacatcagccaggagaagggcccctacggtacttgatgaagcttaatagtgatggcaccctcaccaagggagacgggatcccgtgactcggcttcncaggctcngctcgnggggctggagcgctacctcaccatctccagccctccagtctaggaggatgaggtctagtacttattactagttcaggacgtgggggacacgtggtccggtttggtacgttcgggcggacggggaccaaggcgtcgaccgtctaagggtcaacgcccgaaggcgtcgccccgtcgg

SEQ ID NO: 316042 - DNA, 592 bp, Homo sapiens
  misc_feature: GZ8MTXP02GS2FL.38.7.A07.1.454.CMB.2.raw
  modified_base (398)..(398): a, c, t, g, unknown or other
  misc_feature (398)..(398): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctaggtacttgatgaagtcttaaagtgtgatcggaccacccgtacaaccgaaggggacgaacgggacctcccgtagactcgtcttctcgacgggcctacgagtccgtcggtcggggctggacgtccaccttacccnccaacctagttcccaccgacgtccctaccgtagtccgtaggacgtagtaggaacggtcttacggtaacttaaacgttacgtcgtacgaacggtacgggtcggggactacggtcggttccggtttagggtacgtcgggacgggacggacaaggtcgtcggtaccgtcgttacggccacgacccgtaacggtcccg

SEQ ID NO: 316043 - DNA, 527 bp, Homo sapiens
  misc_feature: GZ8MTXP02IW15U.38.7.A07.1.454.CMB.2.raw
  modified_base (337)..(337): a, c, t, g, unknown or other
  misc_feature (337)..(337): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccgaagggacgacgggatccctgactcgcttctcaggctccngcctcgtggggctggagcgctacctcaccatctccagccctccagtctgacgatggagctgacttagtacgtgtcgaggacggtgggcacgtgtccggtttggggtacgttcgggagggacgggtaccaacgcgtacgacccgtccgtaaggtccgaacggtcccgaaggcccgtccgcccccgttacgg

SEQ ID NO: 316044 - DNA, 664 bp, Homo sapiens
  misc_feature: GZ8MTXP02G6SXY.38.7.A07.1.454.CMB.2.raw
  modified_base (379)..(379): a, c, t, g, unknown or other
  misc_feature (379)..(379): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgccctccctgggagcctcggtcacgctcacctgcactctgagcagtgggcacagcagcaacgcatcgcatggacatacaacatcacgaccaggaacggaacgggcccgtacggtactgaagtagaagtactttaaagtaggtagagtcggacctaccccgtacgaacggaaggggacggacgggtactcccgtgaccgtcgtcttcgccgacgtcctcngtccgtcggtggggctggacgcgtacctacctcaccctatccctcccacgtccctacgtacgtcgtacgggagtacgtaggacggtactacgtacttagttaccgtacggtacgacgggtacggttcggggctacgggttcgggttaccgggtttggggttacggttaccgggggacgggacgggtaaaccgtaagggtcccgtaccggtacccggtttaccggtaacgggtacccgaaccggacccggtaacgggtccccgtaccccgggtcccccgtttacgg

SEQ ID NO: 316045 - DNA, 642 bp, Homo sapiens
  misc_feature: GZ8MTXP02HZ51H.38.7.A07.1.454.CMB.2.raw
  modified_base (250)..(251): a, c, t, g, unknown or other
  misc_feature (250)..(251): n is a, c, g, or t
  modified_base (425)..(425): a, c, t, g, unknown or other
  misc_feature (425)..(425): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctcccgtgggagcctcggtcacgctcacctgcactctgagcagtggcacagcagacaacgccatcgcagtggacatacaacnncagaccagaggaacggccctaggtactgatagaagtctaatgtgatggaccaccctcgaaaccgaaggggacgacgggacctcccgtagacgtccgtctttcgacgacgggtcctaccgacgtccgttcggtggggaccttggacgtcgtacctacctcccaacctaccttccncccacgtcccctaccgtagtccgtaggaggacgtggaacgcgttacgactttaagttccgtagtaccggaacggacgggttcggggaaccttcggttcgggttcccgggttttaggggtaacggttcgggggacgggttaaacggggacctaaacgggtccgtaacgggtacccgttaccggttacggaccgacccggacccggtaacggtcccccg

SEQ ID NO: 316046 - DNA, 562 bp, Homo sapiens
  misc_feature: GZ8MTXP02IEFAU.38.7.A07.1.454.CMB.2.raw
  modified_base (335)..(335): a, c, t, g, unknown or other
  misc_feature (335)..(335): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtactgatgaagcttaatagtgatggcaccctcaccgaagggagacgggatcccgtgactcgcttctcaggctccngcctcgtcgggggctggacgcgcctaccctcacccactcctccacgccctccagtccgtgaggatggaggtctaggtacttacttacgtgtccgaaggtacggtggggactacgtcggtccggtttgggtacgtttcggggacgggacgggaaccgaacggtcgtacggtacccggtaccgtaacgggtccgaacggccccgaaggcccgtccggcccccgttccgg

SEQ ID NO: 316047 - DNA, 615 bp, Homo sapiens
  misc_feature: GZ8MTXP02I0LN5.38.7.A07.1.454.CMB.2.raw
  modified_base (331)..(331): a, c, t, g, unknown or other
  misc_feature (331)..(331): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtggcacagcagcaacgccatcgcatggcatcaacatcagaccagagaacggccctaggtactgatgaagtcttaatgtagatcggaccacctacgaaccgaagggacgacggcctcccgngactcgtcttcgtacgcggcctaccgagtccgtcgtcggggctggacgccgtaccctacccgtccaaccctacttcctcccgacgtccccgtaccacgtcgtaggaacggtagtacggacgtacttaggtaaccttacgttacgtacggtacgtaacgggtacgggtcggggacttacggttcgggttccggggtttaggggtacgttcggggacgggtacggaaccgtaacggtcgtaaccggtaccgtacggtacggtacgaccggtacccgaacggtcccg

SEQ ID NO: 316048 - DNA, 584 bp, Homo sapiens
  misc_feature: GZ8MTXP02HGB84.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagtcttaatagtgatcggccaccctcaaccgaaggggacgacgggacctcccgtgactcgtcttctcgcgggctccgagctcgtggggctggacgcgctacctcacctactcctccacgtccctccgacgtcgtagggagtgacggtacgtcgtactacgttaacgttcgtacgtacgaacggtcgggtacggtacgtacggttccgggttacgggtttacggtaccgggtcggggacgggtaccggtaaacgtcgtacggtaaccggtaccggtacggtaccgacgacccggaccgtacgtccccgg

SEQ ID NO: 316049 - DNA, 505 bp, Homo sapiens
  misc_feature: GZ8MTXP02I56W5.38.7.A07.1.454.CMB.2.raw
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaaatagtgatggcacctcaccaagggngacggggatccctgactcgcttctcacggctccagcctcgtgggggctgacgcgctacctcaccatcnccagcctccagtctgagatgaggntgatntactgtcaggcgtggggcacgtgtcggttgggtagtttcgggcgggaacgggaccaaaggccgtgaacccgttcgaaggtcgacgcccgaaggcctcgccccgtcgg

SEQ ID NO: 316050 - DNA, 653 bp, Homo sapiens
  misc_feature: GZ8MTXP02JCQVX.38.7.A07.1.454.CMB.2.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccaaggacgaacgggccctaggtactgatggaaatcttaaagagtagatggaccaccccgtcgaaccgaaggggacgacgggactcccgtagactcgcttcncaggcctcgngtcctggtcggggctggagccgcctaccgtcacctactccgtacccacgtccctaccgtacggtcgtacggacgggacgttgggacggtcttacggtacttaagttacgtcgtacgacgggtacgggtcgggggacctacggtttggtacccggggttttagggtacgggttccggggacggggtaacggggtaacccgtaaaggtccggttaacggtacccggttacccggttaacgggtccgtaaccgggaccccggttaaggggtccccgttacccggtacccccggttcccgg

SEQ ID NO: 316051 - DNA, 652 bp, Homo sapiens
  misc_feature: GZ8MTXP02JNH5P.38.7.A07.1.454.CMB.2.raw
  modified_base (399)..(399): a, c, t, g, unknown or other
  misc_feature (399)..(399): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctgccctccctgggacgcctcggtcacgctcacctgcactctgagcaggtgggcacgagcagcaacgccatcgcagtggcatcaacatcagccagaggaacgggccctggtactgatagaagtcttaaatgtgattcgccaccctcaaaccgaaggggacgacggacctcccgtagactccgcttcgtcgcggcctaccgagtctcggtggggctggacgccgactaccctcacnctcctccgacgtccctaccgagtccgtaggacggtagtcggacggtcttacggtaaccttaacgttacgtacgggttacgaacgggtaccggggttacgggggtacctaaccgggttcggggttcccggggttttagggggtaacgggtttccgggggaccgggggtaaccggggtaaccgtaaacggtccggtaacggtaaccccggttaccggttacgggtacccgtaccggtacccggaacgggtccccg

SEQ ID NO: 316052 - DNA, 569 bp, Homo sapiens
  misc_feature: GZ8MTXP02JU8KS.38.7.A07.1.454.CMB.2.raw
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagacgggccctcggtacttgatgaagtcttaagtagtgatggccaccctacgaaccgaagggacgacgggactcccgtagacctcgacttcgtacgaggcctccgagccgtcggtggggctggacgcgctacctcaccactccnccacgccctccagtctggagntggacggtctaggaacttattacgtgttaccgaggtaccggtggggactacggttggtccgggtttgggtacgttcggggacgggacggacccgagtccgtacgacccgttacgtaacggtccacggaccccgaaggtccctcccggtccccgtcgg

SEQ ID NO: 316053 - DNA, 569 bp, Homo sapiens
  misc_feature: GZ8MTXP02HGPPT.38.7.A07.1.454.CMB.2.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (396)..(396): a, c, t, g, unknown or other
  misc_feature (396)..(396): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaacgggccctggtacttgatagaagtcttaangtgatgggaccacctacaaccgaagggacgacggactcccgtagactcgcttcgtcncgggctaccgagtcctcgtgggggctcggacgtccgacctaccctcaaccctntcctcccagccctcacgtcgtacggagtacgtggacggcttaggaaccttaattaccgtgttaccgaggtacggttggggactacggttcggtccggtttgggtaacgttcggggacggtacgggaccgaagtcgtcggtaccgtcgtacggtccacgtacccgaacgtcccg

SEQ ID NO: 316054 - DNA, 533 bp, Homo sapiens
  misc_feature: GZ8MTXP02H1O3O.38.7.A07.1.454.CMB.2.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctcggtacttgatgaanctttaanagtgatcggcacccctnaccgaagggngacggatcctgactcgcttcncagctcngctcgtggggctgcgcnctacctcaccatctccagcctccagtcngacgagtagnggactagtacttattactgtacgaggacggtggggactacgtcggtcgtttaggggtacttcggggacgggtacggaccgaagtcgtcgtacccggtcgtaagggtccacgcccgaacggtccgtccgtacccccgttccgg

SEQ ID NO: 316055 - DNA, 594 bp, Homo sapiens
  misc_feature: GZ8MTXP02JM7N9.38.7.A07.1.454.CMB.2.raw
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacancagccagagaacggcctcggtactgatgaagtcttaatagtgatcggcaccctacaaccgaaggggacgacgggactcccgtgactcgtcttcncgnggcctcagctcgtggggctgacgcgctacctcacctatcctccacgtccctaccgacgtcgtaggacggtagtcgggaggtcgttacggaacttaacttacgtcggttaccgaacggtaccgggtagggggcctacggttcggttcgggtttaggggtacggttcgggggacgggacggggaaccgtaacggcgtaacggtaacccggttaccggtaacgggtaccgaacggaccccgtaaggtcccccg

SEQ ID NO: 316056 - DNA, 547 bp, Homo sapiens
  misc_feature: GZ8MTXP02FZ919.38.7.A07.1.454.CMB.2.raw
  modified_base (337)..(337): a, c, t, g, unknown or other
  misc_feature (337)..(337): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaaatagtgatggcaccctcaaccgaagggagacggggactcccgtgatcgcttcncgaggctccagcctcgtggggctggacgcgcctaccgtcaccatcctccacgtccctcacgtcgtaggaggatcggagggtctaggtacttattacgtgtcgaaggcggtggggactacgtcggtccggtttggggtacgttcggggacggacgggtaccaaggtccgtaacggacccggtacgtacggtccgacgacccgaaggtcccg

SEQ ID NO: 316057 - DNA, 674 bp, Homo sapiens
  misc_feature: GZ8MTXP02JRC2J.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcacgccaggaaggaacgggccctacggtacttgatagaagcttaatagtagagtcggaccacctacaaccgaaggggaggacggactcccgtgactcgtcttcctcgcgggtcctaccgacgtccgtcggtgggggctggacgccgtaccttaccctccgaacctacgtcctacccgacgtcccctaccgacgttcgtacgggagggtacgttagggacggtactacggtaaacgtttaacttaccggttaggtacgtaacgggtaccggggtcgggggtacctaacgggttccgggttacccggggtttagggggttaccgggttaccgggggacgggggtaacggggtaacccgaaacggggtccgtaacgggtaccccggttaccggtacgggtaccgaccggtaccccggaacggttccccgg

SEQ ID NO: 316058 - DNA, 572 bp, Homo sapiens
  misc_feature: GZ8MTXP02IL29D.38.7.A07.1.454.CMB.2.raw
  modified_base (175)..(175): a, c, t, g, unknown or other
  misc_feature (175)..(175): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
tcagtcgatcacgtcacgaccggtgctcgatttagcacgtgtcgcaggggctggggagtcagcaccatggcttggaccccactcctcttcctcacccctcctcctccactgcacagggtctctctcccagcttgtgctgaactcaatccgccctctgcctctgcctccctggganccctcggtcacgctcacctgcactctgagcagtgggcacagcagcaaacgccatcgcatggcatcaacatcaagccagagaacgggccctcggtattgatgaagcttaaangtnatggcaccctcaaccgaagggacgaacgggactccctagacttcgcttcgcaggccncncgctcgtgggcgtgacgcgactacctacaccactactaccaccgtcctccgacgtcgtagaggagtaggacggcgtacgtacttacttacgttacgtacgacggacgggtcgggcgtacgtcggtccggtttcgggttacggttcgggacgggacggggaaccggaacgacgtacggaccgtacgtaacggtacgacgaccgacggccgtccgtacccgtccgg

SEQ ID NO: 316059 - DNA, 501 bp, Homo sapiens
  misc_feature: GZ8MTXP02FHN7M.38.7.A07.1.454.CMB.2.raw
  modified_base (180)..(180): a, c, t, g, unknown or other
  misc_feature (180)..(180): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctccctggggancctcggtcacgctcacctgcactctgagcagtgggcacagcagcaacgccatcgcatggcatcaacatcagccagagaagggcccctggtacttgatgaaagcttaatagtgatggcaccctcaccaaggggagacgggatccctgatcgcttctcaggctcagctcgtggggctgagcgctacctcaccatctccagccctcagtcgtggggatggagctgactattactgtcagacgtgggcacgtgtccggtttgggtagttcggcgggtaggaccgaagcgtagccggtccgtacggtcacgccgaacggctcccgg

SEQ ID NO: 316060 - DNA, 683 bp, Homo sapiens
  misc_feature: GZ8MTXP02JTLUK.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtggcacagcagcaacgcatcgcagtggacatcaacatcacgccaagacggaacggtccctacggtacttggactagaagtactttaaagtaggtgacgtcggaccctaacccgtacgaaaccggaaggggacgacggggtaccctcccgtagactccgtcttcgcgacgggtcctaccgcgtccgtcggtcgggggtctacgggacgcccgtacctaccctaccacctaacctcctacccgacgtcccttacgacgttcgtagggaggtacgtcgggtacgtcgttacgtaacttacgttacgtacgtaccggtaacgggtacgggtcggggtacctacgggtttaccggggtccgggttttacgggggtacggttccgggggaacgggtaccggggtaaccgtaggtacccggtaacggtaccccggttaccggtacgggtaccgacccggtacccggaacggtcccccgg

SEQ ID NO: 316061 - DNA, 543 bp, Homo sapiens
  misc_feature: GZ8MTXP02IYUQ7.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaagggccctcggtacttgatgaagcttaatagtgatggcacctcaccgaagggagacggactccctagactcgcttctcaggcctcagcctcgtggggctgagcgctaccctcaccatcctccacgccctccagtctaggacggatggagctagactattacgtgtcaggacggtggggacacgttcggtccgggtttagggtacgttcggggacgggtacggggaaccgaaggtacgtccggtacccgtaccgtacgggtaccgaccggacccggtaaacggtcccgg

SEQ ID NO: 316062 - DNA, 512 bp, Homo sapiens
  misc_feature: GZ8MTXP02HXCGO.38.7.A07.1.454.CMB.2.raw
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgccctcccgtgggagcctcggtcacgctcacctgcactctgagcaggtggcacagcagcaaacgccatcgacagtggacatcaaacatcagccaagagaacgggcctaggtatgatgaaagctaaaatagtgatgcaccctnaaaccgaaaggggagacggactcccgtagactcgcttcncgacggctacagcctcgtggggcngagcgctaccacacactctcacnccacacgactagagagngagagtagatatatgtagagaggnggacgacgtcgtcggttggtacggtcgggacgggacggacgaacgacgtcgacgtacgtacgacgacgaccgacgcg

SEQ ID NO: 316063 - DNA, 553 bp, Homo sapiens
  misc_feature: GZ8MTXP02J3HD2.38.7.A07.1.454.CMB.2.raw
  modified_base (179)..(179): a, c, t, g, unknown or other
  misc_feature (179)..(179): n is a, c, g, or t
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggancctcggtcacgctcacctgcactctgagcagtggcacagcagcaacgccatcgcatggcatcaacancagccagagaacgggccctggtacttgatgaancttaangtgatcggccaccctcgaaccgaaggggagacggggactccccgtgactccgtcttccgcnggcctccngctcgtggggctgacncgcctacctcacccatccgtccacgcctccagtctgaggatgaggtctagtacttacgttactggtacacggggtacgtcgggggacctacggttcggtccggttttagggtacgttcggggacggacgggaccaaggcgttcggaccgttctacgggtaccaccggacccgaacggtccccg

SEQ ID NO: 316064 - DNA, 692 bp, Homo sapiens
  misc_feature: GZ8MTXP02GBMSW.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggcacagcagcaacgccatcgcatggcatcaacatcagccagagaacggccctggtacttgatagaagtacttaagtaggtgagtggacccacccgtacgaaaccgaaggggacggaccggggtacctccccgtggactccgtctttaccgtacgacgggtccctaccgacgtccgtcgggtcggggtactcggacgccgtaccctaccctaccaccctaacttcccgcccaacggtcccccttacgacgttccgtagggacggtacgttcgggacggtacttacggtaacctttaacgtttacggtacgtacggtaacggtacggggttcgggggtaccttacggttacggggttccgggtttttaggggtaccggttaccgggggacggggtaaccggggaaccgtaacggtccggtaaccggtacccggttaccggttacgggtacccgaccgggtacccggaaacgggttcccccgg

SEQ ID NO: 316065 - DNA, 586 bp, Homo sapiens
  misc_feature: GZ8MTXP02ITNSH.38.7.A07.1.454.CMB.2.raw
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggcctggtactgatgaagcttaanagtgatggcaccctacaccgaagggagacggactccgtgactcgctctcaggctcngctcgnggggctgacgcgcctacctccacctactctccacgtcctccacgtccgtgaggagtagacgggtctaggttacttaagttacgttacgtacgacggtaacgggttgggggaccgtaacggttcggttccggggtttaggggttaacggtttccgggggaccggggtaacgggaccgaacggtcgtacgtacccggtacgtaacggtacgaccggacccgaacggtccgtacccggtccccgtccgg

SEQ ID NO: 316066 - DNA, 663 bp, Homo sapiens
  misc_feature: GZ8MTXP02HTF1G.38.7.A07.1.454.CMB.2.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagccctcggtcacgctcacctgcactctgagcgagtgggcaacgngcagcaacgccatcgcatggcatcaacacncacgacgaggacggaccggccgtacggtactagagtagaagtacttaagtagtagacgtcgacctaccgtacgaaacggaagggacgacggtacctcgtagtaccgtcgtccgttcgccggtcaccgagtccgtcgggtggtcgtcggacgtcctacctaccctaccacctactcccaccgaccgtcccgtaccgtacgtacgtagaggacgtacgtacggtacgtacgttacgttacgttacgtacgtacgtacggtacgggtacgggtacgtacggttcggttacgggtttacgggttacgggtacggggtacgggtacgggacggtacggtaccgtaccggtaccggtaccggtacggtaacggtaccggaccggtaccggtaccggtacccggtaccccggttaccggtacccg

SEQ ID NO: 316067 - DNA, 610 bp, Homo sapiens
  misc_feature: GZ8MTXP02HLB47.38.7.A07.1.454.CMB.2.raw
  modified_base (245)..(245): a, c, t, g, unknown or other
  misc_feature (245)..(245): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacancagccagagacggccctaggtactgatgaagtcttaatgtgatcggccaccgacaacgaagggagacggacctcccgtagactccgtcttcgtacgcgggtcctaccgagtccgtcggtggggctggacgccgaccctaccctcacctactaccctccacgtccctccagtctaggaggtatgggaagtcctagtaacttacgttaccgtgtacggtaacggtacgggtcggggactaaccggttcgggttcccggggttttaggggtaccggtttaccgggggacgggtaaccgggaaccgaacggtccgtaaccggtacccggtaccggtacggtacccgaccggtacccgaacggtcccccg

SEQ ID NO: 316068 - DNA, 559 bp, Homo sapiens
  misc_feature: GZ8MTXP02FPBA3.38.7.A07.1.454.CMB.2.raw
  modified_base (240)..(240): a, c, t, g, unknown or other
  misc_feature (240)..(240): n is a, c, g, or t
  modified_base (347)..(347): a, c, t, g, unknown or other
  misc_feature (347)..(347): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaacggccctggtacttgatgaagcttaatgtgatggaccaccctcgaaccgaaggggagaccgggatcccgtgactccgcttctcgacggcctccgngctcggtggggctgaggccgactacctcaccactctccgacgtccctcctagtctgaggatggaggctagacttacttaccgtgtacgaggtacggtggggctacgtggttccggtttggggtacttcgggggacggacggggtaaccgaggccgtaggaccccggttacgaagggtccaacggacccgaggtcctccggacccccgttcgg

SEQ ID NO: 316069 - DNA, 551 bp, Homo sapiens
  misc_feature: GZ8MTXP02FOFON.38.7.A07.1.454.CMB.2.raw
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaagagaacgggccctggtacttgatgaagtcttaaatgtgatggccacccgtcaaccgaagggacgacgggctcccgngatcgcttcncgngcctcgagcctcgtggggctggacgcgcctaccgtcacctattcccnccacgcccttacagtctggacgtatggagctagtactattcgtgtcgaaggcggtgggacctaggttcggtacggttttaggggtacgttccggggacggtaacggggaccaaggtccgtaacggacccgtacggtacggtaccgacggaccgacggtcccg

SEQ ID NO: 316070 - DNA, 638 bp, Homo sapiens
  misc_feature: GZ8MTXP02G28F3.38.7.A07.1.454.CMB.2.raw
  modified_base (281)..(281): a, c, t, g, unknown or other
  misc_feature (281)..(281): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctacggtacttgatgaagcttaaanagtgatcggcaccctacaaccgaaggggacgaacgggatcccgtgactcgtcttctacgacggtctccgagccttcggtcgggggcctgggacgccgacctaaccctcaaccctactcctacccgaacgtccctacgacgtccgtagacgggataggacgggtacctaggttaaacttacgttaacggtcgaacggtacggtacggggttcgggacttacggttcggtttcgggttacggggttaacggttcggggacggggaacggtaacgaacggtccgtaaccggtacccgttacggtaacgggtaccaaccggaacccggtaacggtcccgtacccccggtccccggttaccg

SEQ ID NO: 316071 - DNA, 632 bp, Homo sapiens
  misc_feature: GZ8MTXP02ITKWN.38.7.A07.1.454.CMB.2.raw
  modified_base (287)..(287): a, c, t, g, unknown or other
  misc_feature (287)..(287): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatgaagtcttaaangtgatggcaccctcgaaccgaaggggacgacgggactccccgtagactccgtcttccgtcgacgggtcctcgagcctcggtggggactggacgcgacctacccgtcacctactcctacccgacgtcccctaccgagtccgttaggaaacggtcgttcggaaccggtctacggtaaccttaagttacccgtaggttaccgaacgggtaccgggttcgggggtacctaaccggtttcgggtcccggggttttaggggtaacgtttccgggggacgggtaacggggtaccctaacggtccgtaacggtacccgtcgtacggtccgaccggtacccgaacggtccccgg

SEQ ID NO: 316072 - DNA, 546 bp, Homo sapiens
  misc_feature: GZ8MTXP02GB61K.38.7.A07.1.454.CMB.2.raw
  modified_base (338)..(338): a, c, t, g, unknown or other
  misc_feature (338)..(338): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaatagtgatggcaccctcaccgaaggggacgacgggatcccgtagactcgctctcaggctcngctcgtggggctgagcgctaccctcaccatctccagccctccagtctagacggataggaggtctagtacttattacgtgtacgaggacggtggggactacgtggtccggtttagggtacgttcggggacgggtacgggaaccgaaggtcgtacggacccgttacgtaacgggtccacggtacccgaaggtcctccggcccccgttcgg

SEQ ID NO: 316073 - DNA, 541 bp, Homo sapiens
  misc_feature: GZ8MTXP02G3Z84.38.7.A07.1.454.CMB.2.raw
  modified_base (341)..(341): a, c, t, g, unknown or other
  misc_feature (341)..(341): n is a, c, g, or t
  modified_base (415)..(415): a, c, t, g, unknown or other
  misc_feature (415)..(415): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctcggtacttgatgaagctttaatagtgatggacaccctcaaccgaagggacgacgggatcccgtgactcgcttctcaggctcngctcgtggggctgagcgcctacctcaccatctccacgccctccagttcagacgatggaggctgtactattacgngtacgaggtacggtggggactacggtggtaccggtttggggtacgttcggggacgggtacgggaccaacggtcgtacggacccgtcgtaacggtcaacggcccgaacggcctccgcccccgttcgg

SEQ ID NO: 316074 - DNA, 535 bp, Homo sapiens
  misc_feature: GZ8MTXP02GH8MG.38.7.A07.1.454.CMB.2.raw
  modified_base (158)..(158): a, c, t, g, unknown or other
  misc_feature (158)..(158): n is a, c, g, or t
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctntgcctctgcctccctgggagcctcggtcacgctcacctgcactctgagcagtgggcacagcagcaacgccatcgcatggcatcaacancagccagagaacggccctggtacttgatgaaagcttaaatagtgatggccaccctcaaccgaagggacgacgggactccctgatcgctctcnggcctccagctcgtggggctgacgcgtctacctcaccatcctccacgccctcacgtctagaggactggacggtctaggtaacttaacgttactgtacgaagtacgggtggggctacgtcggttccggtttgggtacgttcggggacggagggtaccaaggcgtaagacccgtcgtacggtcacgcccgaacggtccg

SEQ ID NO: 316075 - DNA, 550 bp, Homo sapiens
  misc_feature: GZ8MTXP02FLRGJ.38.7.A07.1.454.CMB.2.raw
  modified_base (159)..(159): a, c, t, g, unknown or other
  misc_feature (159)..(159): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctntgcctctgcctccctgggacgcctcggtcacgctcacctgcactctgagcagtgggcacagcagcaacgccatcgcatggcatcaacatcagccagagaacgggccctaggtacttgatgaagtcttaaagtagtgatggccaccctacaaccgaaggggacgacggggacctcccgtagactcgtcttcgcgaggcctaccagccgtcgtgggggctggacgccgtacctaccctacacctactccaccacgccctccgagtctaggagataggagcttacgaacttacttacgtcgtacgaggacggtggggactacgtcggtccggttgggtacgttcgggacggtacgggacaagtcgtaacgaccgtcgtacgcacgaccagtccg

SEQ ID NO: 316076 - DNA, 599 bp, Homo sapiens
  misc_feature: GZ8MTXP02I8LS6.38.7.A07.1.454.CMB.2.raw
  modified_base (430)..(430): a, c, t, g, unknown or other
  misc_feature (430)..(430): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacatcagaccagacgaacgggccctacggtacttgatagaagtcttaaatgtgatggaccaccctacaaccgaaggggacgacggacctcccgtagactcgtcttactcgaggtcctccgagtcgtccggtcggggctggacgccgcctaccgtcacccatcctccacgtccctctagtcctggaaggtntacggagtctaggtaaccttagttaccgtggtaccgaaggtacgggtgggactaccggttcggtaccgggttttggggtaacgttccggggacgggtaacggggaacccgtaaggtccgtaaccggtacccgtaccggtaggtaccgaccggacccgtaacggtccccg

SEQ ID NO: 316077 - DNA, 532 bp, Homo sapiens
  misc_feature: GZ8MTXP02F1A6T.38.7.A07.1.454.CMB.2.raw
  modified_base (282)..(282): a, c, t, g, unknown or other
  misc_feature (282)..(282): n is a, c, g, or t
  modified_base (346)..(346): a, c, t, g, unknown or other
  misc_feature (346)..(346): n is a, c, g, or t
  modified_base (433)..(433): a, c, t, g, unknown or other
  misc_feature (433)..(433): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccaggagaacggccctacggtactgatgaagcttaaanagtgatggccaccctacaaccgaaggggacgacggactcccgtagactcgcttctcagcctcgngctcggtggggctgacgccgctaccctcaccctatcctacacgccctcagtctaggagatgaggctagactattacgagtgaggcgngggctacgtgtcggttgggtacgtcggggaggacgggacaacggcgtacggacccgttcgaacggtcacggaccccgaaggccgtccggccccttacgg

SEQ ID NO: 316078 - DNA, 633 bp, Homo sapiens
  misc_feature: GZ8MTXP02IGO64.38.7.A07.1.454.CMB.2.raw
  modified_base (218)..(218): a, c, t, g, unknown or other
  misc_feature (218)..(218): n is a, c, g, or t
  modified_base (374)..(374): a, c, t, g, unknown or other
  misc_feature (374)..(374): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacngcagcaacgccatcgcatgcatacaacatcagccagaaggaacgggcccctacggtacttgagtagaacgtacttaaagtagtagaagtcgggacctaacccgtacgaaaccggaaaggggtacggaacgggtacctccccgtagactcgtcttcncgcggcctcacgtccgtcggtggggctggacgcgccttaccncaccatccnccacgccctaccgagtccgtaggacggtagtcggtaggtaccttaggtaactttaacgttacgtacgtcgaacgggtacgggtcggggtacctacggttcgggttcgggtttacggggtacggttccggggacggggtacgggaaccgtaacggtccgtaacggtacccgtaccggttacggaccgaccggacccggaacggtccccg

SEQ ID NO: 316079 - DNA, 688 bp, Homo sapiens
  misc_feature: GZ8MTXP02G2WWG.38.7.A07.1.454.CMB.2.raw
  modified_base (236)..(236): a, c, t, g, unknown or other
  misc_feature (236)..(236): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcctgggagcctcggtcacgctcacctgcactctgagcagtggcacagcagcaacgcatcgcatggcatcaacntcagccagagaacggccctacggtacttgatgaatcttaaatagtgagtggaccaccccgtacgaaaccggaaggggacggaaccgggtactccccgtagaccgtccgtctttcgacgtacggtcctaccgcgggtccttcgggtacgggggtcctgggaaccggtccgtacccgttaacccctaccgaacccctaacgttcccacccgtaacgtcccctaccgaacgttcgtacgggaaggtacgttacggacggtacgttacggtaacttacgttaaccgttggtaccgtacgggtacgggtacggggtaccgtacggttacgggtccgggttttagggggttaccgttacgggggacgggtacgggtaccggaaacggtccgtacggtaccgttaccggtaaggtaccgacggtacccgaacggtcccgtacccgtacccccggttccg

SEQ ID NO: 316080 - DNA, 590 bp, Homo sapiens
  misc_feature: GZ8MTXP02IIT7T.38.7.A07.1.454.CMB.2.raw
  modified_base (341)..(341): a, c, t, g, unknown or other
  misc_feature (341)..(341): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctcggtacttgatgaagtcttaatagtgatggccaccctcaccgaagggagacgggactcccgtgactcgcttctcgaggctccngcctcgtggggctgacgcgctaccctcaccactcctccacgtccctacccgagtccgtaggacggtactaggacggctacggtacttagttacgtgtacgaggtacgggtgggggacctacggttcgggtcccggggttttaggggttacggttccggggacggggtacggggtaacccaaggtccgtacggtacccggttcgtaacggtccgacgtacccgaacggtcccgtccggtcccccgttcgg

SEQ ID NO: 316081 - DNA, 635 bp, Homo sapiens
  misc_feature: GZ8MTXP02GYM8S.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagacgaacgggccctaggtacttgataggaagtcttaaatagtgaagtcgggaccaaccctacgaaaccgaaaggggacgaacggggtacctaccccgtagtacgtccgtcttacctcgacggggtcctcccgaagtccgttcggtacgggggtctcggacgcggtaccctacctaccgaacctctacctcccgacgccttaccgagtcgtaggacggtatggaacggtcttacggaaccttaagttaccgtaggttacgaaacggtacgggttcggggaccttaacggtcgggttaccgggtttaggggtacgttcggggacgggtacgggaacgtaacggcgtcgtacccgtacgtacggtcgaccgaccgaacggtccccg

SEQ ID NO: 316082 - DNA, 733 bp, Homo sapiens
  misc_feature: GZ8MTXP02HYEG4.38.7.A07.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (245)..(246): a, c, t, g, unknown or other
  misc_feature (245)..(246): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcanggctaanacanncanacagagacgtcctagtatgatgaatataagngagatcgaccaccacgaaacgaagggacgacggacctaccgtagactcgtcttccgacgacgtcctacgacggtccgttacgggtacgggggtacctacggtaccgtacccgtacccgtaacccgtacccgtaacccgtaacccgttacccgtaccccgtacccgtaccccgtaccccgttaccggtaccgttaacgggtaaacgggtaacggtacgggtaacggtacgttaaccgtaacgttaacgttaaccgttacggtaacggtaacgggtaaccggggtacggggtaccggtaccggttaccgggtttaccggggtttacggggtttaccgggttaccggggtaccggggtaaaccggggtaaccggtaaccggtaccggtaacccggtaacccggttaacccggttaaccggtaccggtaacccggtaacccggtaacccggtacccg

SEQ ID NO: 316083 - DNA, 619 bp, Homo sapiens
  misc_feature: GZ8MTXP02IPZFZ.38.7.A07.1.454.CMB.2.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctaggtactgatgaancttaanagtgatggccaccctacgaaccgaagggagaaccgggtatccccgtagtacctccgtccttactcgacggccttaccnggtcctcggtggggcctggacgccgtactacccgtcaccactcctccacgtccctacgtacgtcgtaggacgaagtcggaaggtctacggtaacttacgttacgtagttccgaggtaacgggtcggggactacggttcggtaccgggtttgggttacgttacgggggacgggtacggtaaccgtaaacggtccgtacggtaaccggttccgtaagggtcccgaacggacccggaacgtccggtacccgtcccccgttaccggg

SEQ ID NO: 316084 - DNA, 610 bp, Homo sapiens
  misc_feature: GZ8MTXP02IQN5G.38.7.A07.1.454.CMB.2.raw
  modified_base (245)..(245): a, c, t, g, unknown or other
  misc_feature (245)..(245): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcaggtggcacagcagcaacgcatcgcagtggcataccaaacntccagaccgaaggaggaacggccctaggtacttgatgaagtcttaaagtagtgagtcggacctaacccgtacgaaaccggaagggacgaccggtactacccgtgacctccgtcctttcgacgacggtcccttacgacggtccgttcggtcgggggcctcggggaacgccgtaccctaccctccaacctctccgtaccacgtccctacgtacgtcgtaggacgatacgggacgtctagtactagttaccgtgtaccgaggacgggtcggtctacggtcggtcggtttagggtcgttccgggacgggaacgacgtacgtccgtacgtaccgtcgtaacgtcgacgtaccgacgccgtccgcccgtcg

SEQ ID NO: 316085 - DNA, 651 bp, Homo sapiens
  misc_feature: GZ8MTXP02HXLAU.38.7.A07.1.454.CMB.2.raw
  modified_base (181)..(181): a, c, t, g, unknown or other
  misc_feature (181)..(181): n is a, c, g, or t
  modified_base (248)..(248): a, c, t, g, unknown or other
  misc_feature (248)..(248): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctcccgtgggacncctcggtcacgctcacctgcactctgagcagtggcacagcagcaacgccatcgcagtggcatcaacntcagccagagaacgggtccctggtactgatagaagtacttaatagtgagtcggccacccgtacgaaccggaaaggggacggacggcctccccgtgacttcgtcttccgtcgacgggtcctacgcgtccgttcggtcgggggcttcgaaccggtccgtaccctacccgtaccaacccgtcttccctacccgaccgtcccctcccgtacgttccgaggaacggtctagggtacggtcttaagggttaccttaagttacgtcggttaccggaggtaccggggtgggtccctaggttccgggttaccggggttttggggtaacgttccgggggaacggtacggggaaccgtaacggtccgtaacggtacccggttacgtacggtcgaccggtacccgaacggtcccg

SEQ ID NO: 316086 - DNA, 530 bp, Homo sapiens
  misc_feature: GZ8MTXP02GQUC7.38.7.A07.1.454.CMB.2.raw
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (392)..(392): a, c, t, g, unknown or other
  misc_feature (392)..(392): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaatagtgatggcaccctcacaagggagacgggatccctgactcgctctcagctcngctcgnggggctgagcgctactcaccatctcagcctcagtctgagatgaggctgactattacngtcagacgtggggcacgtgtccggtttgggtacgttcgggacgggtacggggaaccaaacggtccgttacggaacccggttaccgtaacggggtcaaccggtaccccgaaaggggtccctacggccccccgttacggg

SEQ ID NO: 316087 - DNA, 617 bp, Homo sapiens
  misc_feature: GZ8MTXP02IIN8X.38.7.A07.1.454.CMB.2.raw
  modified_base (348)..(348): a, c, t, g, unknown or other
  misc_feature (348)..(348): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtgggcacagcagcaacgccatcgcatggcatcaacatcagccagaggaacgggccctaggtacttgataggaagtcttaaatagtgatggaccacctcgaaccgaagggagacggactcccgagactcgcttcacgnggcctcagtccgtgtcggggctggacgcgacctaccgtacaccacgtcctccacgccctccgacgttccgtaggacggagtcggacggtctacggtaacttacgttaacgtcgtacgtaacgggtacgggtcgggtacgtaccggttcggttacccgggttttggggtacgtttaccgggggaccgggtaacggggaaccgtaacggtaccggtaaccggtacccggtaccggtacggtaccggaccggacccggtaacggtcccccgg

SEQ ID NO: 316088 - DNA, 611 bp, Homo sapiens
  misc_feature: GZ8MTXP02GGDGP.38.7.A07.1.454.CMB.2.raw
  modified_base (178)..(178): a, c, t, g, unknown or other
  misc_feature (178)..(178): n is a, c, g, or t
  modified_base (339)..(339): a, c, t, g, unknown or other
  misc_feature (339)..(339): n is a, c, g, or t
  modified_base (402)..(402): a, c, t, g, unknown or other
  misc_feature (402)..(402): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtgggcacagcagcaacgccatcgcagtggcatcaacatcagccagagaacgggccctacggtacttgatagaagtacttaaagtagtgatcggaccaccctacgaaccgaaggggacgacggactcccgngactcgtcttcgcgacggcctacgagtcgtcggtggggctggacgccgtacctacctcaaccnctcctacccgacgtccctaccgaacgtcgtagggaacggtagttacgggaacgggtacctacggtaacttactttaaccgtggttacgaaacgggttacgggtcggggtactacggttcgggttaccgggtttaggggtacgttcggggacgggtacggaaccgaacgtcgtaacgaccgtacgtacggtcgaccgaccgaaggtcccg

SEQ ID NO: 316089 - DNA, 601 bp, Homo sapiens
  misc_feature: GZ8MTXP02HMDIP.38.7.A07.1.454.CMB.2.raw
  modified_base (244)..(244): a, c, t, g, unknown or other
  misc_feature (244)..(244): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggcacagcagcaacgcatcgcatgcatcaacancagaccagagaacggcctacggtacttgagtagaagtcttaaagtagtagagtcggccaccgtacaaaccggaaggggacgacggactcccgtagactcgacttcacgacgtctcgacgtcgtcggtggggctggacgccgtacctacctcaccctactcctacccacgtccctaccgtacgtccgtaggacgtagtcggacggtactacggtaacttacgttaaccgtgtacgacggtaacgggttacgggcgtacggttcggttcgggtttagggtacgttacgggggacgggacgggaacgtacggtacgtaacggtaccgtacggtacgacgaccggaccgaacggtccccgg

SEQ ID NO: 316090 - DNA, 619 bp, Homo sapiens
  misc_feature: GZ8MTXP02GTLWS.38.7.A07.1.454.CMB.2.raw
  modified_base (239)..(239): a, c, t, g, unknown or other
  misc_feature (239)..(239): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgcatcgcatggcatcaacntcagccagagaacggcctggtactgatagaagtcttaaagtgtagatcggacctacccctagaaccgaaggggacgacgggtactcccgtagactcgacttcncgacggtcctaccgngtcctcggtgggggctggacgtccgcgtacctccaccactctccacgtcctacctacgtcgtacgaggagtagacgtcgtacgtacttacgttacgtacgtacgacggtaacggtacggggcgtacgttacggtacgggtttcgggttacggttcgggtacggggtaacgggtaccggtaaacggccgtaccggtaccggtaccggtaacggtaccgaccggtcccggaaaaaacggtccgtacccggtaccccgtacccgg

SEQ ID NO: 316091 - DNA, 516 bp, Homo sapiens
  misc_feature: GZ8MTXP02FFY5T.38.7.A07.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcanagcagcaacgccatcgcatggcatcaacatcagccagagaaggccctggtactgatgaagnttaanagtgatggcaccctcaccgaagggagacggatccctgactcgctctcaggctcngcagtggggctgagcgtctactcaccactctcacgtccnccgagtctgagntagaggctgatattactgacgagacggtgggcacgtgtccggttgggtacgttcgggacgggacgggacaaacggcgttacggaacccgtcgaacggtcgaccggacccgaacggtcctccgcccccgttaccgg

SEQ ID NO: 316092 - DNA, 641 bp, Homo sapiens
  misc_feature: GZ8MTXP02HL1IM.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtgggcacagcagcaacgccatcgcagtcggacatacaacatcagccaggaggaacggccctacggttactgatagaagtacttaaatagtagacgtcggaccaccctacgaaaccggaagggacgacggtacctcccgtagactcgcttcacgcggtcctcacgtcctcgggtggggctcggacgtccgtaccctacccgtaccacctacgttccctacccgacgtaccccgtaccgtacgttccgtaggtaacggtacgtcgggtaacgtcgttacggtaacttaacgttacgtacggtacgaacgggtacgggttcggggaccttaacggttcgggttaccgggtttagggtacgttcggggacgggtacggaaccgtaacgtcgtaacggtaccgtacgtacggccgtacgaccgtacggtcccg

SEQ ID NO: 316093 - DNA, 601 bp, Homo sapiens
  misc_feature: GZ8MTXP02I9WN5.38.7.A07.1.454.CMB.2.raw
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctcccgtgggacgcctcggtcacgctcacctgcactctgagcaggtgggcacagcagcaacgccatcgcatggcatacaacancagccagaggaaacgggccctaggtacttagatagaagtacttaaatagtgaatgggaccaccctacaaccgaaaggggacgacgggactcccgtagactcgtcttacncgcggctcagctcggtggggctgacgcgtactacctcaccatccctcccagccctccgtacgtcgtacgaggtagtaggaggacgtacgtacgttaacttacgtacgtacgtaacggtacggtacgggtacgtaacggtacggttcggtttagggttacggttacgggtacggggtaacgggaaccggaacgacgtaacggtaccgtaccgtacggtacgtaccggaccgaacggtcccgg

SEQ ID NO: 316094 - DNA, 552 bp, Homo sapiens
  misc_feature: GZ8MTXP02FI77P.38.7.A07.1.454.CMB.2.raw
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagtcgatcacgtcacgaccggtgctcgatttagcacgtgtcgcagggggctgggggagtcagcaccatggctcggaccccactcctcttcctcaccctcctcctccactgcacagggtctcgtctcccagcttgtgctgactcaatcgccctctgcctctgcctcccgtgggagcctcggtcacgctcacctgcactctgagcaggtgggcacagcagcaacgccatcgcatggcatcaacatcagcagagaacggcctggtactgatgaagcttaatagtgatggccaccctacaaccgaagggagacgggatccctgactcgcttcncgaggctccgngcctcggtggggctgacgcgcctacccnccacnctccncncgtccncagtcgaggagagtggacgactagtacttagttacgtagtacgaggtacggtcgggctacggtcggttcgggttaggtacggtcgggacgggaacggacgtacggtccgtacggaccgttacgtaacggacgaccggacccgacggtccgtcccgtccccgtcg

SEQ ID NO: 316095 - DNA, 689 bp, Homo sapiens
  misc_feature: GZ8MTXP02ICYYP.38.7.A07.1.454.CMB.2.raw
  modified_base (240)..(241): a, c, t, g, unknown or other
  misc_feature (240)..(241): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgccatcgcatggcatcaacnncagcagagaacggcctggtactgatgaagtcttaagagtgatcggaccacccgtacgaaaccggaaaggggacgaaccggggtactccccgtagtaaccgtccgtacgtttcncgaaggtcccttccgacgtcgttcggtgggggccttagggacgccgtaccgtaccctccaaaccctctacctcccgacgtccctacccaggtctacgggaggtaacgtcggacggtaccgtacgtaaaccgttatttaaccggtgtaaccggtaacgggtaaccggggtcgggggtacaaccgggtttcgggttaccggggtttgggggttaccgtttaccgggggacggggtaaaccgggaaaccggtaacggtaccggtaccggtaacccgttacccggtaaggtacccgaccggaccccgtaacggtccgtccccgtacccccggttcccgg

SEQ ID NO: 316096 - DNA, 535 bp, Homo sapiens
  misc_feature: GZ8MTXP02JZBXG.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtggcacagcagcaacgccatcgcatggcatcaacatcagccagagaacggccctggtacttgatgaagcttaatagtgatggcaccctcaaccgaaggggacgacggggactcccgtagactcgcttctcgaggcctaccgagctcgtggggcctgacgtcgacctaccctcacccatcctaccacgccctccagtctagaggatggagctgacttatacgtgtacgagccggtggggactcgtcgtccggtttgggacttcgggacggacggacgaagtcgtcggaacccgtcgtacgggtccacggaccccgaaggtccccg

SEQ ID NO: 316097 - DNA, 626 bp, Homo sapiens
  misc_feature: GZ8MTXP02ID4FN.38.7.A07.1.454.CMB.2.raw
  modified_base (400)..(400): a, c, t, g, unknown or other
  misc_feature (400)..(400): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcagccagagaaacgggccctcggtactgatgaagctaatagtgatggcacctcaacgaagggacgacggactccctagactcgtcttctcgacggctaccgacgtccttcggtcgggggcttcgggacgtcccgactaccctccaacctactccnccaacgtccctaccgacgttcgtacggaggtacgtggtaacgtcgttagtaacgttacgttacgtacggtacgaggtaaccggtcggggtactaacggtcggttaccgggttttggggtaacgttaccggggacgggtaaaccggggtaccgtaaacggtccgtaacggtaacccggtaccggtttacgggaccggtaaccggaccccggttaaacggtcccccgg

SEQ ID NO: 316098 - DNA, 623 bp, Homo sapiens
  misc_feature: GZ8MTXP02GG28C.38.7.A07.1.454.CMB.2.raw
tcagtcgatcacgtcacgaccggtgctcgatttagcacgtgtcgcagggggagagctctggggagtcagcaccatggcttggaccccactcctcttcctcacccctcctcctccactgcacagggtctctctcccagcttgtgctgactcaatcgccctctgcctctgccctccctgggagcctcggtcacgctcacctgcactctgagcaggtgggcacagcagcaacgccatcgcatggcatacaacatcagaccaggaaggaacgggccctacggtacttgatagaagtacttaaagtagtgagtcggaccaccctacgaaaccgaaaggggacggacgggtaccctccccgtaggtactccgtcttaccgtcgacggcctacgagtccgtgtcggggctagacgcgaccctacctacacctactcctccacgtccctacgacgtcgtaggaacggagtcggaaggtcctaggtacttaacgttacgtagtaccgagggacggttggggacctaacggttcgggttccgggtttagggtacggttacggggacgggtaacggaacccaggtaccgtaacggtacccgtacgttacggaccgaccggaccgacggtccccg

SEQ ID NO: 316099 - DNA, 489 bp, Homo sapiens
  misc_feature: GZ8MTXP02GSERB.38.7.A07.1.454.CMB.2.raw
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctcggtacttgatgaagcttaanagtgatggcaccctcaccgaagggagacgggatccctgactcgcttctcaggctcngctagtggggctgagcgctacctnaccatctccagcctccagtctgagatgaggctgactattacngtcagacgtggggcacgtgtcgtttgggtattcgggcggacgggaccaagcgtacgaccgtcgtaaggtcacgccaggctcgccctcgg

SEQ ID NO: 316100 - DNA, 608 bp, Homo sapiens
  misc_feature: GZ8MTXP02FK3Y3.38.7.A07.1.454.CMB.2.raw
  modified_base (343)..(343): a, c, t, g, unknown or other
  misc_feature (343)..(343): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcaggtgggcacagcagcaacgccatcgcatggcatcaacatcagccaagagaacgggccctaggtacttgatagaagtacttaatagtgaagtcggacctacccgtacgaacgaaggggacggacggacctcccgngactcgtcttcgcgcggctccgagtccgtcggtggggctggacgccgtccctaccctaccacctactccctccaaccgtccctccgaagtccgtaggaggacgtgaaggtctacgtacttacgttaacgtcgtacgacggtacgggtcgggactacggttcggttaccgggtttggggttaccgttcggggacgggtacgggaaccgacggtcgtaaccggtaccggtaccggtacggtaccgacggtacccggaacggtccccg

SEQ ID NO: 316101 - DNA, 801 bp, Homo sapiens
  misc_feature: GZ8MTXP02FMRKV.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctcgccctcccgtgggacgcctcggtcacgctcacctgcactctgagcaggtgggcacagcagcaacgccatcgcatggcatcaaacatcacgaccgaaggaaggaaccgggcccctaggtacttagagtagaaacgtactttaaagtaggtagagtcgggacccaacccgtaccgaaaccgggaaaggggacggtaaccggggaccttacccccgtaggaacgttccggtacctttaccgaccgacgggtccctaccgtaaggtccgttcggggtacgggggtcttacgggacgtacccggtacccgttaacccttaccaacccgtaaccgtttccctaccccgaccgtaccccgttaccgtaacggttccgttaagggaacggtaggttacgggaacggtacgttaacgtaaccgtttaacttaaccgttacggtaacgtaacggggtaccgggtacgggggtaaccttaccgggtttcgggtttacccgggggttttagggggttaaccggtttaccgggggtaaacgggggtaaccggggtaaaccgaaccgggttaccggtaaccgggtaacccggtttacccggtaacggggttacccgaaccgggtaaccccggaacgggttacccccgg

SEQ ID NO: 316102 - DNA, 567 bp, Homo sapiens
  misc_feature: GZ8MTXP02H1DBH.38.7.A07.1.454.CMB.2.raw
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (471)..(471): a, c, t, g, unknown or other
  misc_feature (471)..(471): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtggcacagcagcaacgccatcgcatggcatcaacatcagccaaggagaacgggccctggtacttgatgaacgtactttaaagtagtgagtcgggaccaacccgtcgaaaccggaaggggacgaccgggtactcccgtagtactccgtctttacgcgacggtcctcgagtcctcggtggggctcgacgccgcctacctcacctatccnccacgtccctacncgtctaggacgtagtcggacgctacgtacttacgttacgngtcgacggacggtcgggactcgtcgtcggtttggtacgtcgggacggtacggacgacgcgtcggaccgtacggtacgcgaccgccgaacggtcccg

SEQ ID NO: 316103 - DNA, 614 bp, Homo sapiens
  misc_feature: GZ8MTXP02GFE0R.38.7.A07.1.454.CMB.2.raw
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtacttgatgaagcttaanagtgatggcaccctcaccgaagggagacgggntcccctgactcgcttcncaggctccgngtcctcgtggggcctggacgcgcctacctcacccatctccaagccctccagtctagacggtatggacgggtctggtaactagtttaacgtcgtacaggaccggttgggggacctaacggttcggtcccggggttttaggggtacgtttaccgggggcgggggaaacggggaaaccccgtaaagggtcccgttaacggggaaccccggtttccggtaacggggttccgaaaccggggccccctaaaggggccctttacccggaccccccgtttccgggg

SEQ ID NO: 316104 - DNA, 785 bp, Homo sapiens
  misc_feature: GZ8MTXP02HQZ0Y.38.7.A07.1.454.CMB.2.raw
  modified_base (180)..(180): a, c, t, g, unknown or other
  misc_feature (180)..(180): n is a, c, g, or t
  modified_base (252)..(252): a, c, t, g, unknown or other
  misc_feature (252)..(252): n is a, c, g, or t
tcagtcgatcacgtcacgaccggtgctcgatttagcacgtgtcgcagggggagagctctggggagtcagcaccatggcttgggccccactcctcttcctcaccctcctcctccactgcacagggtctctctcccagcttgtgctgactcaatcgccctctgcctctgcctcccgtgggancctcggtcacgctcacctgcactctgagcaggtggcacagcagcaacgccatcgcatggacatcaaacctanacgacgacgaaggaacggtaccggtcccgtacggttactaggaagtaggtaaacgtacgttaaagtaggtacgtacgtacggacccctaaccgtaacggaaaccgggtaaaggggacggtaaccgggtacccctacccggtacggtaccgtccggttaccgtttacccgtaggaccggggttccctacggaccgttcccggtacggggtcgggggtacctacgggacgtcccgtaacccgtacccgtacccgaccctaccgttacccgtacccgtaccgtccccctacggtacgttcgtaggtacggtacgtacgggtacgtacgtacgttaacgtttacgttacggtcggtacggtacggggtaccggggtacgggtacccgttacgggttcggggtttacccggggtttaggggtaaccggggttacccgggggaaaccgggggtaacggtacccggtaacggtcccggttaaccggtacccggttaccggtacgggtacccgtaacccgggtacccgtaccgggtccccg

SEQ ID NO: 316105 - DNA, 537 bp, Homo sapiens
  misc_feature: GZ8MTXP02J1VHL.38.7.A07.1.454.CMB.2.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacntcagccagagaacggccctggtacttgatgaagcttaanagtgatggcaccctnaccgaagggagacgggatcccgtgactcgctctcaggctccgngctcgtggggctgacgcgctacctccaccactcgtccacgccctccagtcagtaggatggagtctgactaattctagtcaggtacggtcggggctacgtcgtccggtttgggtacgttcgggacgggacgggaccaacggcgtcggtaccgtaccgtaacggtccgaacggcccgaaaggtccctacggtccccctccggg

SEQ ID NO: 316106 - DNA, 621 bp, Homo sapiens
  misc_feature: GZ8MTXP02IZWYS.38.7.A07.1.454.CMB.2.raw
  modified_base (240)..(241): a, c, t, g, unknown or other
  misc_feature (240)..(241): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacnncagccaggagaacggccctcggtacttgatagaagtctttaaagtggtnagtggccaacccctcgaaccggaaaggggacgaacggggtactcccgtagactcgtcctttacgcgacggcctcccgnggtcctcggtcgggggctggacgccgtcctaccctccgacctactccgtaccacgccctccgtacgtcgtaggaggactacgggacggtcttagtaccttacgttacgtacggtacgagggtaccgggtcggggactacggttcggttaccggggtttagggttaccggtcgggggtaccgggaacgggtaccgaacggtcgtaccggacgtcgtaacggtcgacggtccgacggcctcccggtccccgtacg

SEQ ID NO: 316107 - DNA, 587 bp, Homo sapiens
  misc_feature: GZ8MTXP02FP3JQ.38.7.A07.1.454.CMB.2.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagcagagacggccctcggtactgatgaagtntaatgtnagtgcacctcacgaagggacgacggntcccngacctcgaccttntacgacggccttccaggtcctcggtgggggcctggaacggtcnccttaaccctcacccacttcctacccgacgtaccccttccgaacgttcgtacggaacgggacgtagggacggtacttacgaacgttactttaacgtcggtaccagggtaacggtcggggactacggtgtccgggtttgggtacgttcgggacgggtacggaccgaacgtcgacgtaccggtcgtaacggcaacgccgacggtcctccggccccgttacgg

SEQ ID NO: 316108 - DNA, 581 bp, Homo sapiens
  misc_feature: GZ8MTXP02G3VHM.38.7.A07.1.454.CMB.2.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcaggtgggcacagcagcaacgccatcgcagtggcatcaacntcagcagagacggcctggtactgatgaagtcttaanaggtgatggaccacccgtacaaccggaagggacgaccgggtactcccgtagactccgcttcgacgaggcctcgaggtcctcgggtcgggggctagggacgccgacctaccctcaacccatcccgtaccacgtccctaccgagttcgtagacggtnacggcgtctaggtacttacttacgngtaccgaggtacgggtggggcctaggttcggtaccggtttgggaacgttccggggagggtaccggacgacggcgtacggaccgttcgaacggtcacggaccgagtccgtccgcccgtacgg

SEQ ID NO: 316109 - DNA, 687 bp, Homo sapiens
  misc_feature: GZ8MTXP02JDOEL.38.7.A07.1.454.CMB.2.raw
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgccctcccgtgggacgcctcggtcacgctcacctgcactctgagcaggtggcacagcagacaacgccatcgcagtcggcatacaanancagccaagacggacggcctcggtaactgatagaatcttaaagtagtgagtcggacccaccgtacaaccgaaggggacgacggaccctccngactcgtctctacgcggtcctaccgagtccgtacgggcggggtactacggacgccgtaccctaccgtaccacctacgttccnccgacgtcccacgtacgtccgtagggacgtagacggacggtactacgtaacttacgtaccgttcggtaaccggtagggaccggggttaggggacctaaccgggtttcggggttacccggggttttaggggtaacccggggtttaccgggggaaccggggtacgggggtaacccgtaacgggttcccggttaaccggtaccccggtttaaccgggtaaccggtaccggaaaacccggtcccggtaaaaccggttcccccggg

SEQ ID NO: 316110 - DNA, 547 bp, Homo sapiens
  misc_feature: GZ8MTXP02GPYMR.38.7.A07.1.454.CMB.2.raw
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (398)..(398): a, c, t, g, unknown or other
  misc_feature (398)..(398): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacggccctggtacttgatgaagcttaaatagtgatcggaccaccctcaaccgaaggggacgacgggactcccgtgactcgcttcncngctcngctcggtgggctgacgccgctacctcaccatcctccgacgccctcagtcgtgacgntggacggctagtacttattacgtgtaccgaggtacggtggggctacggtggtccggtttagggtacgttcggggacgggacggtaaccacggtcgtacggacccgtcgtaacggtccgacgacccgacggtccgtccggaccccgtcgg

SEQ ID NO: 316111 - DNA, 734 bp, Homo sapiens
  misc_feature: GZ8MTXP02ISLX1.38.7.A07.1.454.CMB.2.raw
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcaggtggcacgagcagcaacgccatcgcagtggcatcaacatcagaccagacgaacggcctagtactgaatgaagtcttaaagtgtgagtcggaccaacccctacgaaccggaaaggggacgaccggggtactcccgtagtaccctccgaccttcgtacgacgggtccttaccgacggtccgttcgggtacgggggtccttcgggaacggtcccgtacccttaaccccgtccaaaccctactccctacccgaccgtcccctaccgtacgtccgtagggaacggtacgtacgggtaacggtccgttaacggttaaccctttaagtttaccgtacggtaaccggtaagggtaacggggttcgggggacctaaccgggtttccgggttaccgggggttttaggggtaaccgggtttaccgggggaacggggaccggggtaaacccggtaaacggtcccggttaaccggtacccggttacggaacggttacccgaacggtacccgtaacgggccctcccgggtaccccctacgg

SEQ ID NO: 316112 - DNA, 599 bp, Homo sapiens
  misc_feature: GZ8MTXP02JVSZW.38.7.A07.1.454.CMB.2.raw
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtggcacagcagcaacgccatcgcagtggcatcaacatcagccagagaacggcctcggtactgatgaagtcttaangtgatgcacctcaacgaaggacgacggactcccgtgactcgcttacncacggcctaccngcctcgtggggtcctgacgccgtacctacccgtcaccctatccctccagtccctacgtcgtcgtaggacggtacgtacggtacgggcttacggtaactttacgttaacgttcggtaccgtaagggtccgggttaggggcctaacggtttcgggtcccgggttttggggtaacgtttcggggacggggacgggtaacccgaacggtcgtcgggtaccgtaccggtacggtccgaccggacccgtaacgggtccccg

SEQ ID NO: 316113 - DNA, 649 bp, Homo sapiens
  misc_feature: GZ8MTXP02GKOU8.38.7.A07.1.454.CMB.2.raw
  modified_base (158)..(158): a, c, t, g, unknown or other
  misc_feature (158)..(158): n is a, c, g, or t
  modified_base (179)..(179): a, c, t, g, unknown or other
  misc_feature (179)..(179): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctntgcctctgccctccctgggancctcggtcacgctcacctgcactctgagcagtggcacagcagcaacgccatcgnatgcancantcagcagagacggcctgtactgatgaatcttaagtagtgagtcggaccaccgtcaaccgaaggggacgacgggacctacccgtagactcgcttcgcgacggtcctccgagtcctcgacggggtctcggacgccgaccctaccctacgacctactccgtacccgacgtcccgtacctagttcgtagggtaacggtacgttcggacgggtacttacggtacccttaagttaccgtacggtacgtaaacgggtccggggttacggggtacgtaaccgggttacgggttcccggggttttaggggttaccggtttacgggggaccggggtaaccggggaccgtaaacggtcggtaaccggtacccggtaccggttacgggtaccgacccggtaccggaaccggttccccgg

SEQ ID NO: 316114 - DNA, 675 bp, Homo sapiens
  misc_feature: GZ8MTXP02J3PLR.38.7.A07.1.454.CMB.2.raw
  modified_base (174)..(174): a, c, t, g, unknown or other
  misc_feature (174)..(174): n is a, c, g, or t
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcccgtgggacncctcggtcacgctcacctgcactctgagcagtggcacagcagcaacgccatcgcatggcatcaacntcagccagacgtacggccctggtactggatggaatcttaaagngnacgtcgaccaccgagaacggaggacgacgtctccgtnaccgtcgtactcgcgacgcctacgngccgtggtacggctacgacgtcccgtcctaaccctcgaaccctactcccgtaccgacgtcccgtaccgtacgtacgtacggtacgtacgtacggtacgtacgtacgtacgttacgttacgtacgtacggtacgggtaccgggtacgggtaccggttaccggttaccgggttaccggggtttacggggttaccgggtaccggggtaccggggtaaccgggtaaccggtaaccggtaccggtacccggtaacccggttacccggtaaccggtacccggtacccggtacccggtacccggtaccccggtaccccggtacccccggtcccgg

SEQ ID NO: 316115 - DNA, 620 bp, Homo sapiens
  misc_feature: GZ8MTXP02INNPM.38.7.A07.1.454.CMB.2.raw
  modified_base (216)..(216): a, c, t, g, unknown or other
  misc_feature (216)..(216): n is a, c, g, or t
  modified_base (365)..(365): a, c, t, g, unknown or other
  misc_feature (365)..(365): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcanagcagcaacgccatcgcatggcatacaacatcagccagacgacggccctggtactgatagaagtcttaaatgtgagtcggaccacccgtacgaaaccgtaagggacgacggaccttcccgagtaacgtcgtcttcgcgaggtcctacgnggtcctcggtggggactaggacgcgacctaacctcaacctacgtcctacccgtacgtcccttaccgacgtcgtaggacggagtacggacggtactacggtaacttacgttaacgtcggtacgtaaggtacggttcggggtactaaccggttcggtacccggtttgggggtacgtttaccggggacgggtaaccgggaaccgtaacggtcgtaacggtaccgtacgttacggaccgaacgtaccggaacggtcccg

SEQ ID NO: 316116 - DNA, 559 bp, Homo sapiens
  misc_feature: GZ8MTXP02G9TKK.38.7.A07.1.454.CMB.2.raw
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (445)..(445): a, c, t, g, unknown or other
  misc_feature (445)..(445): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcatggcatcaacatcacgccagagaacggccctcggtacttgatgaaagtcttaaatagtgaagtggccacctcaaccgaaggggagacgggacctcccgtgactcgacttcncgnggtctcgagctcgtggggctggacgccgcctacctccacctactccctccgacgtccctccgacgtctaggaggatacggagctgtacttaagttacncgtacaggcggtaggggctacgtcggtccggtttggggtacgttacggggcggtacgggaccgtaacggcgtaacgacccggttacgtacggtcgaccggacccgtaaggcccg

SEQ ID NO: 316117 - DNA, 697 bp, Homo sapiens
  misc_feature: GZ8MTXP02HM2NK.38.7.A07.1.454.CMB.2.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctcctgggacgcctcggtcacgctcacctgcactctgagcagtgggcacagcagcaacgcatcgcatggcatcaaacatcacgccaaggacgaacggtccctggtacttgatagaagtcttaaangtgagtcggcctaccctagaacccgaaaggggacaacggggtactccccgtaggaacctcgcctttcncgaaggtccacgtgtccgtcgtcgggggcttggacggcctaccctaccgtccaacctatccctaccacgtcccttcgaacgtcgtagggagtagtcgggaaggtccttagtaacttacgttaacgtcggtaaccgtacggtacgggttacggggactaaccggtttcgggtccccgggttttaagggggtacccggtttacggggggaaccgggttaaccgggaaccgtaaacgggttcccgtaaccgggttaccccgggttacggttaacccggggccttaaacccgggggtacccccgaacgggggttccccctaccccggtttacccccccggttacggg

SEQ ID NO: 316118 - DNA, 585 bp, Homo sapiens
  misc_feature: GZ8MTXP02JVZI9.38.7.A07.1.454.CMB.2.raw
  modified_base (276)..(276): a, c, t, g, unknown or other
  misc_feature (276)..(276): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaaggccctggtactgatgaagcttaanagtgatggcaccctcaaccgaagggagacgggatcccgtagactcgcttctcgaggcctccagctcgtggggctgagcgcctacctcaccatcctccgagtccctccgagtcctaggaggatcggaggtctaggtacctattaccgtgtacgaaggtacggtggggactacggttcgggtacccggtttaggggtaacgttcgggggacgggtaacgggtaacccgaaaggtccgtacggtaacccggttccgttaacgggacccgaacggaccccgaaagggtcccgtacccggtacccccgttcggg

SEQ ID NO: 316119 - DNA, 592 bp, Homo sapiens
  misc_feature: GZ8MTXP02FTN83.38.7.A07.1.454.CMB.2.raw
  modified_base (219)..(219): a, c, t, g, unknown or other
  misc_feature (219)..(219): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtgggcacngcagcaacgccatcgcatggcatcaaacatcagccagagaacgggccctaggtacttgatagaagtcttaatagtgatcggccaccctcgaaccgaaggggacgacgggtacctccctagactccgcttctacgcgggcctcgagtccgtcggtcgggggctggacgtcccgcctaacctcaaccctatcccgtccacgtcccttcgacgtcgtaggaggactgggacgtcgtagtactaacgttacgtacgtcgaggtacggtggggactacgttcggtccgggtttagggtacgttacggggacgggtaacgggaaccaggtccgtaacggtaccgtacgttaaacggcgaccggacccgaaacggtcccg

SEQ ID NO: 316120 - DNA, 684 bp, Homo sapiens
  misc_feature: GZ8MTXP02FMVVA.38.7.A07.1.454.CMB.2.raw
  modified_base (184)..(184): a, c, t, g, unknown or other
  misc_feature (184)..(184): n is a, c, g, or t
tcagtcgatcacgtcacgaccggtgctcgatttagcacgtgtcgcagggggagagctctgggggagtcagcaccatggcttggaccccactcctcttcctcaccctcctcctccactgcacagggtctctctccagcttgtgctgactcaatccgccctctgcctctgccctcccgtggggacncctcggtcacgctcacctgcactctgagcaggtggcacagcagcaacgccatcgcagtcggcatcaaacatcagaccagaggaacggccctaggtacttagagtagaagtacttaagtaggtgaacgtcggaccctaacccgtacgaaaccggaaaggggacggaacgggtacctcccgtaggtactccgtaccttaccgtacgacgggtcctaccgaggtccgttcgggtacggggtctacggacgtccgtaccctaccgtaccaaccctacgtcccacccgacgtcccctacgaggttcgtagggaaggtagtcggacggtaccttaggtaactttaacgttcgtaggtacgaacgggtcgggtacggggtcctacggttcgggttccggtttaggggttaacggtcgggggacggggtaacgggtaaccgaagggtaccgtaacggtacccggtttaccggtacgggtaccgacggtaaccccggaacggttccccg

SEQ ID NO: 316121 - DNA, 645 bp, Homo sapiens
  misc_feature: GZ8MTXP02J2Q1E.38.7.A07.1.454.CMB.2.raw
  modified_base (246)..(246): a, c, t, g, unknown or other
  misc_feature (246)..(246): n is a, c, g, or t
  modified_base (371)..(371): a, c, t, g, unknown or other
  misc_feature (371)..(371): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgcctccctgggacgcctcggtcacgctcacctgcactctgagcagtggcacagcagcaacgccatcgcatggcatcaacntcagccagagacggccctaggtactgatagaagtcttaaatgtgactcggcctacccgtcaaccgaaggggacgacggacctcccgtgactcgtcttccgcgacgggcctaccgagtcgttcggngggggtactggaaccgtccgtacccttaaccctacccgtaccctaactccctaccgacccgtccctaccgtacgtccgtggaaggactcgggacgtacgtacggttaacttaacttccggtacgtaccgacggtacggggtcggggtaccctaacggttcgggttcccggggttttggggtaccggttaccgggggaccgggaacgggacctaacgggtccgtaacggacccggtttaccgacgggtaccgacggaccccggtaacgtccccgg

SEQ ID NO: 316122 - DNA, 728 bp, Homo sapiens
  misc_feature: GZ8MTXP02FPNYH.38.7.A07.1.454.CMB.2.raw
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctccctgggacgccgtcggtcacgctcacctgcactctgagcagtgggcacagcagcaacgcatcgcatggcatcaacatcagcaggagaacggccctaggtactgatagaagtacttaaagtaggtgtatcgggacccaaccccgtacgaaacccggaaagggggacgaaaccggggtactaccccgtagacccgttccggtacctttcgtacgacggtcccttaccgacggtcctcgggtcgggggcctaggaacgccgtaccctaaccctccaaccctatcctacccgacgtccctacccgaggttccgtagggaacggtattagggacggtccgttacggtaacctttacgtttaccggtagtacccgtaacgggtccgggttacgggggacctaaccggttcgggttcccggggttttaggggttaaccggttccgggggacggggtaaacggggtaaacccgaacgggtacccgtaacggtacccggttacccgtaaggggtcccgaaaccggtaccccggaacgggttcccctacccgggtaccccccgtttacccggg

SEQ ID NO: 316123 - DNA, 533 bp, Homo sapiens
  misc_feature: GZ8MTXP02G0MBK.38.7.A07.1.454.CMB.2.raw
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgccctcccgtgggacgcctcggtcacgctcacctgcactctgagcaggtgggcacagcagcaacgccatcgcatggcatacaacatcaagccaagacggaacggccctaggtacttgatagaagtcttaaagtaggtgaagtcggacccaccctacgaaaccggaagggacgacgggactccgtgactcgcttcgcacgcncngctgngggctgacgcactacncacatcncgacgctcagtcagagnaggngtctacgtactattacgtgtacgagacggcggctacgtcgtacggtttgggtacgtcgggacggacggacgacgcgtacgaccgttacgaacgtcgacgaccgacgccgtaccgcccgtcg

SEQ ID NO: 316124 - DNA, 626 bp, Homo sapiens
  misc_feature: GZ8MTXP02F1N66.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgccatcgcagtggcatcaacatcagccagagaacggcctggtacttgatgaagtcttaatgtgagtcggaccacccgtcgaaccgaaggggacgacgggactcccgtagactcgtcttcgcgcgtccacgacgtcgtcggtcgggcgtagacgccgtaccctacctacgacctacttccgaccaccgtcccgtacgtacgttcgaggacgtagacggtacgtacgttacgtaacgttacgtacgtacgtacggtaaacggtacgggtcggaacgttcgggttcgggtttaccgggtttaggggtaaccggttcggggaacggggaccggttaaaccgcggttaccgtaaccggtacccggttacggtaccggtaccgaccggtaacccggtacgtcccccgg

SEQ ID NO: 316125 - DNA, 620 bp, Homo sapiens
  misc_feature: GZ8MTXP02I9QY6.38.7.A07.1.454.CMB.2.raw
  modified_base (364)..(364): a, c, t, g, unknown or other
  misc_feature (364)..(364): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgccctcccgtgggagcctcggtcacgctcacctgcactctgagcagtgggcacagcagcaacgacatcgcagtcggcatacaacatcagccaagagaacgggcccctggtacttgatagaagtcttaaatagtgaagtcggaccacccgtacaaccggaaggggaacggtacgggacctcccctggactccgtcttccncgaggcctacgacgtccgttacggtggggcctgacgccgtcctacctcacctatcctccacgccctaccgagtccgtaggagacgtggagctagtactacgttacgtcgtacgagggtaccggtgggggactcggttacggtccgggttttcggggtaacggttccggggtaacggggaacgggtaacccggtaggtaccggtaacggtacccggttaccgtacgggtaccgaaccggtcccggaaacgtccccgg

SEQ ID NO: 316126 - DNA, 594 bp, Homo sapiens
  misc_feature: GZ8MTXP02HMV38.38.7.A07.1.454.CMB.2.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (455)..(455): a, c, t, g, unknown or other
  misc_feature (455)..(455): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctcgcctcccgtgggacgcctcggtcacgctcacctgcactctgagcaggtggacacagcagcaacgccatcgcagtggacatacaaacatcaacgccaggaacggaacggccctaggtactgatagaatacttaangtagagtcggaccaccctacgaaccggaagggacgacggactccgtagacctcgcttcgacgagtcctcngtcgtcggtgggctagacgcctacctaccncaaccnctcctaccgactcctaccgagtcgaggagagtagacgtctagtaactagttacgngtacgaacgggtcggtacgggactacggtcggttccggggtttagtacgggtcgggacgggaacggacgaacgtccggtacgtacccgttacgaacggacccaaccggaccggaccggtccctacccggcccgttaccg

SEQ ID NO: 316127 - DNA, 550 bp, Homo sapiens
  misc_feature: GZ8MTXP02F13AY.38.7.A07.1.454.CMB.2.raw
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagtcgatcacgtcacgaccggtgctcgatttagcacgtgtcgcaggggctgggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtactgatgaagcttaaagtagtgatggcaccctacaccgaagggacgacgggactccgtgactcgctcgcagctccngctcgtggggctgacgcgtctacctcacctancctacagccctccagtctgagntggngctagactattactgtacgagtacggtggggacctacgtcggtccggtttggggtacgttcggggacgggtacgggaaacctacggccgtacggacccggttaccgaagggtaccgaccgtacccggaacggtcctccggtacccccgtcggg

SEQ ID NO: 316128 - DNA, 635 bp, Homo sapiens
  misc_feature: GZ8MTXP02IX8QZ.38.7.A07.1.454.CMB.2.raw
  modified_base (175)..(175): a, c, t, g, unknown or other
  misc_feature (175)..(175): n is a, c, g, or t
  modified_base (382)..(382): a, c, t, g, unknown or other
  misc_feature (382)..(382): n is a, c, g, or t
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctctgcctctgcctccctgggacncctcggtcacgctcacctgcactctgagcaggtgggcacagcagcaacgccatcgcagtggcatcaaacatcagaccaggaggaacggcccttcggtacttgatgaacgtcttaaagtaggtgacgttggacccaccccgttacgaacccggaaaggggacggaacgggtactccccgtagacctccgcttctcgaggacccttcgngcctcggtcggggctgcgaccgcctaccgtccacctactcctaccctaccgccctaccgtagtcgtgacggagtaggacggtcgtacgtaacttagttacgtagtacgagggtacggtcgggacgtacggtcgttcggggtttagggttacggtcggggacgggtaacgggtaccgaacggccgtaccggtaacctcggggggtaacgtacggacggtacccggaacggtccgtcccgtaccccggttcccgg

SEQ ID NO: 316129 - DNA, 619 bp, Homo sapiens
  misc_feature: GZ8MTXP02I7L5Z.38.7.A07.1.454.CMB.2.raw
  modified_base (239)..(239): a, c, t, g, unknown or other
  misc_feature (239)..(239): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgcctctgcctctgcctccctgggagcctcggtcacgctcacctgcactctgagcagtgggcacagcagcaacgccatcgcagtggcatcaacntcagccagaggaacggccctaggtacttgataggaagtcttaaagtagtgaatcggacctaccccgtacgaaaccggaaggggacgaccgggactcccgtgacctcgtcttcncgaggcctaccgnggtcctcgggtcggggactggacgtccgcctaacccncgaccctatcccaccacgccctccgagttccgaggacgggtactgggagtcttacggactttaattacgtgtacgaacgggtcgggtcgggactacggttcgggttccggtttagggtacggtcggggacggtaaacgggaccgtaagtccggtaccgccgttacggaaggtaccgaccggtacccgaacggtcccgtccccggtcccccgttacgg

SEQ ID NO: 316130 - DNA, 543 bp, Homo sapiens
  misc_feature: GZ8MTXP02HQR7Z.38.7.A07.1.454.CMB.2.raw
  modified_base (173)..(173): a, c, t, g, unknown or other
  misc_feature (173)..(173): n is a, c, g, or t
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgcatcgcatggcatcaacatcagccaggagaacggccctggtacttgatgaagcttaanagtgatggaccaccctcaccgaagggagacggactccgtgactcgcttacncgagcctcngctcgngggctgacgctcactcacatctcacgtcctacagtctgacgngtgagtctagtactatactcgtacaggacggtcggggctacgtggtccggtttagggtacgttcgggggacggacggtacgaaacgtccgtacggtaacccgttcgtaaacggtcgaaccggacccgtaacgggccctaccggtacccccggttcgg

SEQ ID NO: 316131 - DNA, 601 bp, Homo sapiens
  misc_feature: GZ8MTXP02GZQRG.38.7.A07.1.454.CMB.2.raw
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtgggcacagcagcaacgccatcgcatggcatcaacatcagccagagaacgggccctaggtacttgatgaagcttaanagtgatcggcacccgtcaaaccgaaggggacgacgggactcccgtagactcgtcttcncgaggtcctacagcgtcgnggggtctgacgccgtaccctactcacctactcctcccgactccctccgagttcacggagggatggaggctagaacttagttacctagtcgaacggtacgggtacggggtactaaccggttcggttacccgggtttggggttaaccggttcgggggacgggggtaaccgggaaccgaacggttccgtaacgggtacccgttacggtacgggtacaccggtaccccgaaacgggtcccg

SEQ ID NO: 316132 - DNA, 618 bp, Homo sapiens
  misc_feature: GZ8MTXP02HERUR.38.7.A07.1.454.CMB.2.raw
  modified_base (178)..(178): a, c, t, g, unknown or other
  misc_feature (178)..(178): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgccatcgcatcggcatcaacatcagccagaggaacggccctaggtactgaatagaagtcttaagtcgtgacgtgggaccctacccgtacgaaccggaagggacggacggactcccgtagacgtcgtcttcgtcgaggcctacgagtcctcggtggggactgacgcgtaccgtaccgtcaccactcctacccgacgtcccttaccgagtccgtaggacggtacgtacggtacggtcgtacggtaacttaacgttcgtacgtacgtacggtacggtagggtactcggttacggtacgggtttacggggtaacgtttcggggacgggaacggaccgtacggtacgtaacggtaacccgttcggttaccggtaccgtaaccggaccgtaacggtcccg

SEQ ID NO: 316133 - DNA, 679 bp, Homo sapiens
  misc_feature: GZ8MTXP02IAN9O.38.7.A07.1.454.CMB.2.raw
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagtcgatcacgtcacgaccggtgctcgatttagcacgtgtcgcagggggctgggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcagtgggcacagcagcaacgcatcgcatggcatcaacntcagccaaggacgaacgggcccctcggtacttgactagaagtctttaaagnggtagagtcggaccacccctacgaaccggaaggggacgaacgggtactcccgtagactcgtcttcncgacggcctaccgnggtccgttacgggtcgggggtacctaggggacgtcccggtacccttacccgtaccaccctaacttccgtacccgacgtccccttaccgtacgttccgtagggacggtagtacgggtaggaccttacggtactttacgttaaccgtcggtaccgacggggtacgggtacggggtctaacggttcggttaccggggtttggggttacggttccgggggacggggtaacggggtaaccgaacggtccgtacggtacccgttcggaacggtaccgacggacccggaagtcccgtacccgtccccgttacgg

SEQ ID NO: 316134 - DNA, 611 bp, Homo sapiens
  misc_feature: GZ8MTXP02ITZDP.38.7.A07.1.454.CMB.2.raw
  modified_base (216)..(216): a, c, t, g, unknown or other
  misc_feature (216)..(216): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcanagcagcaacgccatcgcagtggcatcaacatcagccaggaggaacgggcccctaggtacttgatagaagtactaatgtgatcggacaccctcgaacgaaggggacgacggactcccgtgacgtcgtcttcncgnggtcctccgagtcctcgtgggggctagacgcgtcctacccgtcacccactccaccccagtcccgttccacgttccgtaggaggtaacctggaacggtcccttagaaccttagtttacgtcggtactaacgggtccggttacgggggactaccggttcgggttcccggtttaggggtaccggttacgggacgggtacgggaacctaacggtcgtaaccggaacccgttccggtacggtaccgacggacccgtaacggtcccg

SEQ ID NO: 316135 - DNA, 490 bp, Homo sapiens
  misc_feature: GZ8MTXP02HA4LE.38.7.A07.1.454.CMB.2.raw
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctcggtacttgatgaagcttaatagtgatggcaccctcaccaagggagacggggatccctgactcgcttctcaggctcngctctggggctgagcgctacctcaccatctcagcctccagtctgagntgaggctggactattactgtcagacggtggggcactggccgttgggtattcgggcggagggaccaaagctacgaccgtcaaggtcacgacccaggcacggcccctcgg

SEQ ID NO: 316136 - DNA, 563 bp, Homo sapiens
  misc_feature: GZ8MTXP02IN1H3.38.7.A07.1.454.CMB.2.raw
  modified_base (356)..(356): a, c, t, g, unknown or other
  misc_feature (356)..(356): n is a, c, g, or t
  modified_base (469)..(469): a, c, t, g, unknown or other
  misc_feature (469)..(469): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcaggtggcacagcagcaacgccatcgcatggcatcaacatcagccaggagaacgggccctaggtacttgatagaagtacttaaagtagtgaagtggacctaccctacgaaccgaaggggacgacgggacctcccgtagactcgtcttcncgcggctccagcgtcgtcgggctgacgcgtcctaccctcacctactccctaccacgccctccgacgtcgagacggatcggagctagtacttagttacgtgtacgaggtacggngggtactacggtcggtccggtttgggtacgtcggggacggacgggacgaggcgtaacgtaccgtacgtacggcgaccggtaccgaacggtcccg

SEQ ID NO: 316137 - DNA, 587 bp, Homo sapiens
  misc_feature: GZ8MTXP02FQ9QA.38.7.A07.1.454.CMB.2.raw
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctacggtactgatgaaagtcttaaataggngaatcggacctacccctacgaaccgaaaggggacgacggggactcccgtgacctcgtctcncgacggcctcgngtcctcggtggggctggacgccgtctacctccaccgactcctaccgcnccctcgacgtcgtgaggntgggacgctagtacttattacgtgtacgaggtaccgggtggggactcgttcgggtcggtttagggtacgttcggggacgggtacgggaacgacggtccgtacggtcccgtaccggtaaggtaccaacggacccgaacggtcccgtccggtcccccgttcgg

SEQ ID NO: 316138 - DNA, 561 bp, Homo sapiens
  misc_feature: GZ8MTXP02JCQ1I.38.7.A07.1.454.CMB.2.raw
  modified_base (178)..(178): a, c, t, g, unknown or other
  misc_feature (178)..(178): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcagtggcacagcagcaacgcatcgcatggcatcaacatcagccagacgaaggcccctggtacttgatgaagtcttaatagtgatcggccaccctcgaaccgaagggacgacgggactcccgtagactcgcttcgcgnggtcctccgagctacgtggggctggacgcgctacccgcacctatcctccncgcccttaccgagtctaggacggtatcggaagtctaggtaaccttaagttccgtgtaccgtaagcgggtgggactacggtcggttaccggtttagggtacgttcgggacggtacgggacctaggtacgtcgtacccggtacgtacggtcgacgtacccgaggtccccg

SEQ ID NO: 316139 - DNA, 647 bp, Homo sapiens
  misc_feature: GZ8MTXP02JCMUC.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggagcctcggtcacgctcacctgcactctgagcgaggtgggcagagcagcaacgccatcgcagtggcatacaacatcagccagagaacggccctacggtacttgatagaagtacttaaagtaggtagagtcgggaccctaccgtaccgaaaccggaaaggggaacgaccgggtacctcccgtagtacgtaccgtcttaccgtcgacgggtccttaccgacgtccgttacgggtcgggggtctagggaccgtccgtacccttaccctacccacctacgtcccacccacgtccctaccgacgtcgtaggaggtacgtaggacggtctaggtaacttacgttacgtcgtacgacggtacgggtacgggtctacggtttcgggttcggtttaggggtacggttcgggacgggtaccggtaacgaacggtcgtaaccggtacccgtcgtacggtccgaccggtaccgacggtccccg

SEQ ID NO: 316140 - DNA, 653 bp, Homo sapiens
  misc_feature: GZ8MTXP02IN8P9.38.7.A07.1.454.CMB.2.raw
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcagtggcacagcagcaacgccatcgcatggcatcaacatcagccaagagacgggcctaggtactgatgaagtcttaaagtgtagactcgggacccaaccctcgaaccgaaaggggacggaccgggaactcccctagacttccgctttaccncgcgggtccnccagtccgttccggtgggggcctgggacgcgaccctacctaccacctactcctaccacgtccctccgagtcgtacggtaggtagtacggtacggtacttacgggtaaaccttactttaaccgtcggttaacggtagggtaccgggtgggggtacctacggtttcggggttccgggttttacgggggttacggttcgggggaccgggggtacgggtaaccgaacgggtccgtaacggtacccggttacgttacgggaccgtaccggaccccggtaacggtcccccg

SEQ ID NO: 316141 - DNA, 772 bp, Homo sapiens
  misc_feature: GZ8MTXP02F0QJZ.38.7.A07.1.454.CMB.2.raw
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
  modified_base (414)..(414): a, c, t, g, unknown or other
  misc_feature (414)..(414): n is a, c, g, or t
tcagtcgatcacgtcacgaccggtgctcgatttagcacgtgtcgcagggggctggggagtcagcaccatggcttggaccccactcctcttcctcaccctcctcctccactgcacagggtctctctcccagcttgtgctgactcaatcgccctctgcctctgcctccctgggancctcggtcacgctcacctgcactctgagcaggtgggcacagcagcaacgcatcgnagtggcatacaacatcagaccgaaggaacggaacggccccttaggtacttagatagaagtcttaagtaggtagacgtcggaccaccctacgaaccggaaggggacgtacgggcctaccgtagacccgtccgtcttcgacgacgcctacgcggtccgtcgggtggggcctggacgccgtcctacccnctaaccctacgtccctacccgaccgtcccgtacccgttaaggtccgttagggaggtacgtacgggacggtccgttaacggttaacgtttacgtttaaccggtcgggtaaccgtacgggggtaccggggttacgggggtacccttaaccggggtttccgggtttacccgggggtttttagggggttaaaccggtttccggggggaaaccgggggtaaccggggtaaacccgtaaacgggggtcccgttaaccggggttacccccgtttaacggggtaacccgggttaccccggtaaccggggaaccccggggtaacccggtttcccggttacccccggtaccccccgggttttaccggg

SEQ ID NO: 316142 - DNA, 630 bp, Homo sapiens
  misc_feature: GZ8MTXP02GMTRX.38.7.A07.1.454.CMB.2.raw
  modified_base (355)..(355): a, c, t, g, unknown or other
  misc_feature (355)..(355): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcaggtggcacgagcagacaacgccatcgcatggcatacaacatcagccagacggaacggccctacggtacttgatagaagtcttaatagtgagtcggaccacccgtacgaaccgaagggacgacggactccgtgactcgcttcacgacggcctcncgtctcggtacggggctggacgcgtcctaccgtcacccactacctccgaccgtccctaccgtaagtccgtaggacggacgttacgggacgtaccgttaggtaaccctttaagttaccgttgtaacccgtaagggtaccgggttcggggaccttacggttgggttacccgggtttaggggtacggttacggggacgggacgggtaaccaggtccgtacggacccgttacgtaacgggaccaccggacccgtacggcccgttcccggcccgttaccg

SEQ ID NO: 316143 - DNA, 733 bp, Homo sapiens
  misc_feature: GZ8MTXP02HHYV4.38.7.A07.1.454.CMB.2.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctcgcctctcgcctcccgtgggacgcctcggtcacgctcacctgcactctgagcaggtggcacagcagcaacgccatcgcagtcggctanacaacntcacgacccaaggaacggaaccggccccgtacggttacttagagtaggaagtacttaaaagtaggtgaagtcggacctaacccgtacgaaaccggaaaggggacggtacggggtacccctacccgtagacgttccggtcctttacgaccgtacgggtccctaccggtaacggtcccgttcggggttaggggccgttacgggaaccggtcccgtaccctttaacccgaccgtaaccccgtacgttaccctcccgtaacccggtccccttaaccgtaacgtccgttaaggaacgggtagtacgggtacgtacgtacgttaaaccgttacgtttaacggcgttacggaacgggtacggtacggggtaacctcgggtttaacgggtcccgggttttaggggttaccggttacggggacggtacggggaacctacggtaacgtccgacggtaccgttacggaccgaccggaccgaccggtcccgg

SEQ ID NO: 316144 - DNA, 494 bp, Homo sapiens
  misc_feature: GZ8MTXP02FRU97.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaaatagtgatggcaccctcaccaagggagacgggatccctgatcgcttctcaggctcagctctggggctgagcgctacctcacatctccagcctccagtctgagatgagctgactatactgtcagacgtggggctacgtgtccggttgggtacgttcgggcgggacgggaccaagcgtgacccgtcgtaggtccgacgacccgaaggtcccg

SEQ ID NO: 316145 - DNA, 776 bp, Homo sapiens
  misc_feature: GZ8MTXP02GMBLX.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgcctccctgggacgcctcggtcacgctcacctgcactctgagcaggtgggcacagcagcaacgccatcgcagtggcatacaacatcagccaagaggaacgggcccctaggtacttgatagaagtacttaagtgtagaatcggaccacctacgaaaccggaaggggacggacgggacctccccgtagtactccggtctttaccgacgtacggggtcccttcccgaacggtcccgttaccgggtcggggggtccttaacggggaccgtacccggtccccttaaccccgttacccgaaaccccgtaaccgttacccccttccccgaacccggtccccccgtttaacccgaaaccggttcccgtaaacgggtaaagggtcgttacgggaaacggggttccttaacgggttaaacctttaaccgtttaaaccggttcggtaaccggtaccggggttaaccggggttcgggggtacccgtaaccgggttccgggtttcccgggggttttaggggtaacccggtttcgggggaccggggtaacgggaccgtaaacggtccgtaaccggtaaccccggtacggtacgggtaccgaccggtacccgaacggtcccccgg

SEQ ID NO: 316146 - DNA, 612 bp, Homo sapiens
  misc_feature: GZ8MTXP02FHBCX.38.7.A07.1.454.CMB.2.raw
  modified_base (347)..(347): a, c, t, g, unknown or other
  misc_feature (347)..(347): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaacgggccctggtacttgatagaagtcttaaatagtgaatggaccaccctacaaccgaaaggggacgaacgggacctccctagatcgcttcncgacgctaccgagcctcgtgggggctagacgcgcctacctcaccactcaccacgccctcacgtctaggaggatggagctagaacttacttaacgtcgtacgacggtacggtcgggggacaacgtcgggttacccgggttttagggggtaacggtttacgggggaccggggtaacgggggtaaaccccgaaggtaccggtaaccggtaaaccccggttacccggtaacgggttaccgtaaccggaaccccggaacgggttcccccg

SEQ ID NO: 316147 - DNA, 579 bp, Homo sapiens
  misc_feature: GZ8MTXP02HABQN.38.7.A07.1.454.CMB.2.raw
  modified_base (181)..(181): a, c, t, g, unknown or other
  misc_feature (181)..(181): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatcgccctctgcctctgccctccctgggacncctcggtcacgctcacctgcactctgagcaggtggcacgagcagcaacgcatcgcntggcatcaanancagcagaggacgcctagtactnatgaatcttaatgtgatcgacctaccgtacaaaccggaagggtacgacgggacctcccgtagactcgtcttacgcgaggtcctacgtcgccgtcggtacggggctacggacgccgtaccctaacctccgaacctacctacctcccgtaactcccctaccgtacgtcgtaggacggtagtgacggctagtacttagttacgtagtacgaagtcgggtcggtactcgtcggtacggttgggtacgttacgggacggtacggtacgtaggaccgtcggtaccgtacgtacgtacgaccgaccgacgtcccg

SEQ ID NO: 316148 - DNA, 675 bp, Homo sapiens
  misc_feature: GZ8MTXP02I64XC.38.7.A07.1.454.CMB.2.raw
  modified_base (178)..(178): a, c, t, g, unknown or other
  misc_feature (178)..(178): n is a, c, g, or t
tcagtcgatcacgtcacgaccggtgctcgatttagcacgtgtcgcaggggagagctctggggagtcagcaccatggcttggaccccactcctcttcctcaccctcctcctacactgcacagggtctctctcccagcttgtgctgactcaatcgccctctgcctctgcctccctgggancctcggtcacgctcacctgcactctgagcagtggcacagcagccaacgccatcgcatggcatacaacatcagccaagacgaacgggtccctcggtaacttgactagaagtacttaagtagtgagtcggaccacccgtacaacgaagggacgacggtacctcccgtagactccgtcttacgtaccgacgggtccttacccggaagtcccgtacgggtcggggtctacgggtacgccgtacccgtaccctcgtaaccctactcccgtacccgaacgtcccctaccgtacgtccgtaggtaaacggtccgtagggtaacgggtacctaaggttaaaccttacgttaaccggttcgtacggtaaacgggtaaccgggtcgggggtaacttacggttaccggttacccggggtttagggttacggtaccgggggtacgggtacgggaccgtaacggtcgtaacggacccgtacgttacggaccgacggaccgtacggtcccg

SEQ ID NO: 316149 - DNA, 644 bp, Homo sapiens
  misc_feature: GZ8MTXP02JEOUQ.38.7.A07.1.454.CMB.2.raw
  modified_base (243)..(243): a, c, t, g, unknown or other
  misc_feature (243)..(243): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtggcacagcagcaacgcatcgcatggcatcaacntcagccagagaacggccctgtactgatagaagtcttaatgtgatggaccaccgtacgaaccgaaggggacgacgggactcccgtagactcgtacttccgcgacggtctccgagccgtcggtgggggcctggacgccgacctaccctcacctactctacccacgtccccttacgacgttccgtaggaacggtacgtacgggtaacggtccttacgggtaaccttaacgtttaccgtggtaacccggtagggtaaccggggttgggggcctaccggttcgggttacccggggttttaggggtaaccgggttccggggaacggggtacgggaacccgtaacggtccgttaaccggaaccccggttacgtaacggggtaccaccggaccccgtaacggttccccg

SEQ ID NO: 316150 - DNA, 742 bp, Homo sapiens
  misc_feature: GZ8MTXP02HLI5W.38.7.A07.1.454.CMB.2.raw
tcagtcgatcacgtcacgaccggtgctcgatttagcacgtgtcgcagggggagagctctgggggagtcagcaccatggcttggaccccactcctcttcctcaccctcctcctacactgcacagggtctctctcccagcttgtgctgactcaatcgccctctgcctctcgcctcccgtgggacgcctcggtcacgcctcacctgcactctgagcgaggtcgggcacgagacagaccaacgccatcgacagtcggacactacaaactacacgaacgaccgaaggaacgggaaaccgggtcccgtacggttacttggaagtaggaagtacttaaagtaggtagacgtcggaccctaacctaccgaaccggaagggacggacggacctccgagtacgtcgtcttacgacgcggtcctcgacggtccgtacgggggtcggcgtacggacggtacccgtacccttcccctaaccgtaccctcctacccgtacccgaccgtaccccgttaccgtaggttaccgaggaaacggtgtacgggtacgtacgtaacgtacttaacttcggtagtaccggtaaacgggtccggggtacgggtacgtaaccggggtttcgggtttaccgggggtttacgggggttaccgggttacccgggggtaaacggggtaaccggggaaccgtaccggtaccggtaaccggtacccggttacggaccggtaccgacccggtaaccgggaccgtttccccggg

SEQ ID NO: 316151 - DNA, 616 bp, Homo sapiens
  misc_feature: GZ8MTXP02I50Z3.38.7.A07.1.454.CMB.2.raw
  modified_base (461)..(461): a, c, t, g, unknown or other
  misc_feature (461)..(461): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctcgccctcccgtgggacgcctcggtcacgctcacctgcactctgagcaggtggcacgagcagaccaacgccatcgcagtggacatacaacatcacgaccaaggacggaacggccctaggtactgatggaatacttaagtagagtacgcggaccacctacgaaccgagggaacggacggcctaccgagtactcgtcttcgacgtcggcctacgtacgccgtcggtcggggctaggacgtccgtaccctacctaccgacctactccgtacccacgtccctacgagtcgtaggacggtancggacgtgtacgtacttacgtagtcgttacgaacggtcgggtcgtacgtacggttcggttaccgggttagggttacggtcgggaacgggtacggaaccgaggtacggtaaccggtacccgtacggtacggacgaccggacccgtacggtccccgg

SEQ ID NO: 316152 - DNA, 784 bp, Homo sapiens
  misc_feature: GZ8MTXP02JAGZI.38.7.A07.1.454.CMB.2.raw
tcagtcgatcacgtcacgaccggtgctcgatttagcacgtgtcgcagggggagagctctggggagtcagcaccatggcttggaccccactcctcttcctcaccctcctcctccactgcacagggtctctctcccagcttgtgctgactcaatccgccctctcgcctctcgccctcccgtgggacgcctcggtcacgcctcacctgcactctgagcgaggtgggcacgagcagaccgaaccgccagtccgacacgtggactactacaacactacacgaccggtaagaacgggaaccgggtcccgtacggttacgttagaacgttaggtaaacgttaacgtttaaagtggtaggtaacgtaccgggaccctaacccgtacgaaaccgggaaaggggtacggaaccggtccgtacccgtaggtactccgtcgttaccgacgtcggtcctaccggacgtccgttacggggttcggggctacgggaccgtacccgtaccctacccgtaccgtaacctacctacccgtcccacgtccccgtacgtacgttcgacgggtaacggtacgtacgggtacgtaccgttaggttaaaccgtttaccgttacgttacggaacggtaacggggtacgggtacggggtacttacggggttaccggtttcggggtttttaacggggtcggggtttaccgggggaaccggggtaccggtaaaccgtaacggtcccgggtaaccgggttacccggtaaccgggtacgtacccggaaccggtacccggtaacggtccccggg

SEQ ID NO: 316153 - DNA, 687 bp, Homo sapiens
  misc_feature: GZ8MTXP02FNOZB.38.7.A07.1.454.CMB.2.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
tcagtcgatcacgtcacgaccggtgctcgatttagcacgtgtcgcaggggagagctctgggggagtcagcaccatggcttggaccccactcctcttcctcaccctcctcctccactgcacagggtctctctcccagcttgtgctgactcaatcgccctctgcctctgccctcccgtgggacgcctcggtcacgctcacctgcactctgagcaggtgggcacagcagcaacgccatcgcatggcatcaacntcagaccagacggaacgggccctaggtacttgatgaagtacttaaagaggtgaacgtcggaccacctcgaaccgaaggggacgacggtcctacccgtgactcgtacttcgacgngcctcagtccgtggtcgggggctaggtacgcccgtaccgtacccnccgtaaccctacttcccgtaccgtaccgtccccttacgtacgttcgtaacgggtaggtaagtacgggacggggtcttaacgtaaccgtttaacgtttaacgtcggttacggtacggggtaaccgggtcgggggtaccgttaaccggttcggggtttcccgggtttagggggttaccggtccgggggtacggggtaacgggtacccgtaagggtccgtaaccggtacccggttacccggaacgggttaccgaaccggtacccggtaacggttccccggg

SEQ ID NO: 316154 - DNA, 574 bp, Homo sapiens
  misc_feature: GZ8MTXP02HL0LG.38.7.A07.1.454.CMB.2.raw
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatcgcctctgcctctgcctcccgtgggacgcctcggtcacgctcacctgcactctgagcagtgggcacagcagcaacgccatcgcatggcatcaacatcgagccagagaacggccctaggtactgatgaagtcttaangngatcggaccacctanaaccgaagggacgaacgggactcccgtagactcgcttcacaggctcngcgtcgtgggactgacgcncctacncaccatcccncactcctacgtagtcgaggagagtaggacggtactacgtaacttacgtacgtaggacgagggtaccgggtcgggactacggttcgggtttcgggtttagggtacggtccggggacgggaacggaccgtaacggcgtaccggtaccgtacggaacgtaccgaacggtacccgacggtccctacccggtcccgtcg

SEQ ID NO: 316155 - DNA, 648 bp, Homo sapiens
  misc_feature: GZ8MTXP02JT1N3.38.7.A07.1.454.CMB.2.raw
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatcgccctctgcctctgcctcccgtgggacgcctcggtcacgctcacctgcactctgagcagtgggcacagcagcaacgccatcgcagtggcatcaacatcacgaccagacgaacgggccctacggtacttgatgaagtacttaatagtgagtcggaccaccgtcgaaccgaaggggacgacggacctcccgtagacgtccgtcttacgtcgacggtcctacgacgtcctggtcggggctaggacgcgtaccttaccgtccaacctactccctacccgacgtccctaccgtacgtcgtagggtacggtagtcggtacggacttacggtaacttaacgtttacgtacgtacggtaacggtacggggtacgggtccgaacggtttcgggttaccgggttttacggggtacgttccgggggaacgggtacgggaaccgtacggtacgtaaccggtaccggtaccggtacggtaccgaccggtacccggtaacggtcccccgg

SEQ ID NO: 316156 - DNA, 670 bp, Homo sapiens
  misc_feature: GZ8MTXP02F9V9Z.38.7.A07.1.454.CMB.2.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctcccagcttgtgctgactcaatccgccctctgcctctgcctccctgggacgcctcggtcacgctcacctgcactntgagcaggtgggcacgagcagcaacgccatcgcatggcatacaanatcagccagacggaacgggcccctaggtacttgaactagaaagtcttaaagtgtagagtcggacctacccgtacgaaccgaaggggtacgaacgggtactcccgtagtacctccggtcctttacnccgaggtccttaccgngtcctcggtggggctagacgtcgacctaccgtcacccactccgtacccacgccctaccgtacgtcgtaggacggagtacggtaacgcgtacggtactttaacgttacgtagttacgacggtacgggtacggggtctacggttggttaccgggtttagggtaacggtttccgggggacggggtaaacgggtaaccgaaacgggtccgttaccggaccggttaccggttaacgggtaccgtaacgggtaccccgaaacggggtccctacccgggtcccccgttaccgg

SEQ ID NO: 316157 - DNA, 684 bp, Homo sapiens
  misc_feature: GZ8MTXP02G4VN4.38.7.A07.1.454.CMB.2.raw
  modified_base (173)..(173): a, c, t, g, unknown or other
  misc_feature (173)..(173): n is a, c, g, or t
  modified_base (394)..(394): a, c, t, g, unknown or other
  misc_feature (394)..(394): n is a, c, g, or t
  modified_base (487)..(487): a, c, t, g, unknown or other
  misc_feature (487)..(487): n is a, c, g, or t
tcagtcgatcacgtcacgaccggtgctcgatttagcacgtgtcgcaggggctggggagtcagcaccatggcttggaccccactcctcttcctcaccctcctcctccactgcacagggtctctctccagcttgtgctgactcaatccgcctctgcctctcgcctccgtgggacncctcggtcacgcctcactgcactcgtgacgcgtaggtcgggaccaacgacgcgaagaccgaaaccgccaagtccgacagtcggacaactaccaacacgtacacgaccgaaaggaacggtaaccggtccgttacggttactgaagtacgaagtacgttaaatggtacgacgtacggaccctaccgtacgaaacggtaacgggacgtaacggtacctccgtanccgttcgtcttacgcgacgcttacgcgtcgtcggtcggtactcggacgcccgtaccttaccactaaaccttctcccgtaacgccgtcccgttnaacggttcgaacggtaaggcgttaaacggcgttatacgttaaatttcggacgttaccgaacgcgggtaacggggcttacggtacggttcggggtttacggtcgggttaaccggcggggaggtaaacggaacctcggttccgaaaccggtcccttggaaccgtacaccggtacgaccggtcctaaccccggtacgtcc

SEQ ID NO: 316158 - DNA, 703 bp, Homo sapiens
  misc_feature: GZ8MTXP02IYOCS.38.7.A07.1.454.CMB.2.raw
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (460)..(460): a, c, t, g, unknown or other
  misc_feature (460)..(460): n is a, c, g, or t
tcagtcgatcacgtcacgaccggtgctcgatttagcacgtgtcgcaggggagagctctggggagtcagcaccatggcttggaccccactcctcttcctcaccctcctcctccactgcacagggtctctctcccagcttgtgctgactcaatccgccctctgcctctcgccctcccgtgggacgcctcggtcacgctcacctgcactctgancgaggtggcacagcagacaacgccagtcgacagtggacactacaactancgacgaccgaagacggaaccgggtccctacggtacttgacgtagaacggtacttaaagtagtcgaagtccggacctaaccccgtacgaaacggtaaggggacggaccgggaccctcccgtagtacttccgttacttaccgacgaccggtcctacgaacggtccgttcggggcgggtctacggaccgccgtaccttacccnccgtaaacctctccctaccgaccggtccctacgtacgtccgtaaggacgtacgtagaccggttaactaggtaaacctttacgttaacggtcgttacggacgttaaccgggggtcgtaaccgttccgggtttacggttccgggtttaacggggtacggttcggggaaccggttacggaaccgtaacgtcgttaaccggtaccgttaccggttacggacgtaccccggaaccgtacggttccccg

SEQ ID NO: 316159 - DNA, 647 bp, Homo sapiens
  misc_feature: GZ8MTXP01A69BG.19.21.B10.1.454.CMB.2.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagtactctcgtgcacgaccggtgctcgatttagtgtcgtcgcaagagaggagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccanatctttaanacatacaanatanaaactntanctagacagcagacgaccagacacgcctacgtaggctcgctactatttacgngggactacgtaccgtaacccgggagtcccggggtacctacgaccgtattcgaggtcggacgacgggtcgggtacgtacgggactagttactttacacttcctaccaacctactacgacgacgacgtaccgtacgacgacggacgtacgtaagtagtaggtacggggtacgttaagtttaagtttagtttacgttactaaacttaaattaatttaatttaactttacgttacggttacggttaacggttacggttacggtaaacgggttaacggtaacggtaaggttacgttacgttacgtaacgtacgtaacgtagtacggttacgtcgcgtaaccg

SEQ ID NO: 316160 - DNA, 632 bp, Homo sapiens
  misc_feature: GZ8MTXP01CUU31.19.21.B10.1.454.CMB.2.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
  modified_base (418)..(418): a, c, t, g, unknown or other
  misc_feature (418)..(418): n is a, c, g, or t
tcagtactctcgtgcacgaccggtgctcgatttagtgtcgtcgcaagagaggaggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccaccatcaactgacaagtccagccanaattctttaanacatacaanaatanaaactntanctagacagacagacgacagacacgcctacgtagctcgctactagtttacgngggactacgtaccgtaacccgggacgttcccggggtacctacggaccgtattcgaggtcggacgagggtcgggtcgtagggaactagtacttcactcacacancagcacgcctgacaggctagaagtagtggtaggggtacttaagttttatagttacgaactaaacttaatttaagtttatttaacgttaccggtttcgggtacgggttaaccggttaccggaaccggtaaacggggaccgttaaaggggtgttaaacgttacgttaccgaaaggtaaccgtaacgttgggtacggttactaacgaaccgtaaccg

SEQ ID NO: 316161 - DNA, 603 bp, Homo sapiens
  misc_feature: GZ8MTXP01D0I83.19.21.B10.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacaactgacaagtccagccacaattctttanacagttaccaaacaatagaaactacttagcttaggaccagcagagaccaggacagcctctaggctgctcatttacgnggactacgtaccgtaccggacgtcccgggtccctacgacgtatcgaggtcgacgcggtcgggtcgtagggactagtacttcactctacacatcacgacgacgcgtacgacgacgacgtagtaagtagtaggggtaggtagttagtttagttattagtactaaactaaattaatttaattaacttacgttacgttaacggtacggttacggtaccggaacggtaacggtaaggttaggttagttacgtaagtaacgtaacgtacgtagttagtcgttcgtaacg

SEQ ID NO: 316162 - DNA, 632 bp, Homo sapiens
  misc_feature: GZ8MTXP01DGU23.19.21.B10.1.454.CMB.2.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagaggagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttaanactatacaanaatanaaactntanctagacagcagacgacagacacgcctacgtagctgtctactactttacgngggactacgttaccggtaacccgggtacgtccccggggtacctacggaaccgtatcgagtcggacgacgggtcgggtcgtagggactagtacttccactctacacatcgagcacgccgtgacgaggactagaaagtgtgtacggggtactttaaagttttattaacgttagtaaactaaacttaaatttaatttaacgtttacttaccgttacggtcggttaaccgttaccggaacggtaaacgggttacgtaaagggtagttaattacgttacggaacgaacgtaacggtggtacggttactaacgttaacgtaaccg

SEQ ID NO: 316163 - DNA, 623 bp, Homo sapiens
  misc_feature: GZ8MTXP01COD1V.19.21.B10.1.454.CMB.2.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtcgcccgacggggacatcgtgatcgacccagtctccagacctccctggctgtgtctcgtggcgagccggccacgatacactgacaagtccagaccataattctttanactagttaccaaacaatacgaaaactctagctacggaacngacagacgaccaggacacgtcctaccgtaggctagtctactactttacgcgggactacgtccggtaacccgggagtcccggggtcctacgaccgtattcgagtcgccaggtccgggtntagggactagtacttcactcacacacncgacgcacgcgtagcgaggacgtagaagtagttacggtacggttactttaagtttacttaagttactaactaaattaagtttattacttacgttacgttacggtacggtaaccggtcgggacggtaacgggaacgtagggtcttaacgttacgttacgaacggtacgtaacggtggtacgactcgaaccgtaag

SEQ ID NO: 316164 - DNA, 691 bp, Homo sapiens
  misc_feature: GZ8MTXP01DJ1DT.19.21.B10.1.454.CMB.2.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (335)..(335): a, c, t, g, unknown or other
  misc_feature (335)..(335): n is a, c, g, or t
tcagtactctcgtgcacgaccggtgctcgatttagtgtcgtcgcaagagaggagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgactgacaagtccagccactaattcttttaanactacgttaccaaanaatagaaaactatagctacggaccagacaaagacgaccaggacacgccctacgtagctcgtctactacgtttacgngggactacgtacccggtaacccggggacgtccccgggggtccctacggaccgtattcgaggtcggaacgagggtccgggtactaggggaactagtactttaccacttcctacaacatacacgcacgtccgtagacgaggactagaagtagtggtacggggtactttaagttttacttaagttacgtaaacctaaacttaaatttaatttaactttaacgttaccgtttacgggtacgggttaacccggttaccgggaaacccggtaaacggggaaccgtaaaggggttagttaaacgttacgttaacgtaacggtaaacggtaacgtgggtacggaccgtaacgaacccgtaaccg

SEQ ID NO: 316165 - DNA, 641 bp, Homo sapiens
  misc_feature: GZ8MTXP01EC130.19.21.B10.1.454.CMB.2.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (455)..(455): a, c, t, g, unknown or other
  misc_feature (455)..(455): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgaggccgggccacgataccgaactcgacaagtccagccaactattctttanactacttaccaanatagaaactactagctagacagacagacgacgagacacgtcctcgtagctcgtactacttacgtttacgcggtacctacgtacccggtaacccggggtacgtccccggggtaccccctacggaccgtagttcgacggtcggaccgtgggtccgggtacgtagggactagttacttcaccttcacacctanacgacgacgacgcgtcgcgacgacgtagtaagtagtagggtgtagttagttagttattacgtactaataattaattaattattacgttcggtaacggtacggttaccggtaccggaacggtaacggtaacggttaggttagttacgtaagtaacgtaacgtacgtacggttacgtcgttcgtaacg

SEQ ID NO: 316166 - DNA, 538 bp, Homo sapiens
  misc_feature: GZ8MTXP01C4UN0.19.21.B10.1.454.CMB.2.raw
  modified_base (379)..(379): a, c, t, g, unknown or other
  misc_feature (379)..(379): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
  modified_base (501)..(501): a, c, t, g, unknown or other
  misc_feature (501)..(501): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtgccatccgtccggggacagagtcgctagcgacagtgttgcttggcacgtgggtcaggccacgtccccagtcgagaggtctagagtggcgtaggggaagacatattcaatcgtccaaacgacgtaggaaataacaaattanacgacacctatctgttagagagtcgaatagaacaatacaaacgtanaacgaacaagtacgaaagaaacctagttccnccctagcaagcctcacctctgcgaccttccggagaccgagggttnttagtaatacgtgtacggaacgacgccccaagtaacg

SEQ ID NO: 316167 - DNA, 581 bp, Homo sapiens
  misc_feature: GZ8MTXP01B7I20.19.21.B10.1.454.CMB.2.raw
  modified_base (236)..(236): a, c, t, g, unknown or other
  misc_feature (236)..(236): n is a, c, g, or t
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagataggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactaatcttttanactacgttaccaaacaatagaaaactacttagcttaggtaccagcagagaccaggacagcctctaggctgctactatttacgtgggctagtccgtaacccggggaagtcccgggggtccccctggacgtattcgagtcggcnggcgggtcgtgggacagtacttcgactctcactancagcacgcctgacaggctgaagngtggggtcggtacttaggtttattagttcgacctaaataattattaattattacgttcggtaaggtacgttacgggaccgaaggggtaaccgtaagggttgaagttactaacgagaacggtaacgtggttacggccttggaaccc

SEQ ID NO: 316168 - DNA, 649 bp, Homo sapiens
  misc_feature: GZ8MTXP01DVFPW.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccgggacaggacgtcgcgtacgcgacgtagtgttgcgttggcacggtggtcacggtcacgtccccagtcgaggtaggtctaggaggtggacggtaggggaaggactattattcaagtcgtaaccgaaacgtacggtaaggtaaactaactaaattacgtacgacctaacctattcgtgttagaagtacgtacgaactagaaactaaagtacgaaacgtagaacgaactaagtaaccgaaaccgtaacctacgtttccctacccgtacgactaccggtacctacgggtaaccccttcgttacggttacccggaacccgttacccgggaacgggtaaccgttacggggttcttaagttaacgttacgtggtaacgggaacgttacccggaaccccaagtaaccg

SEQ ID NO: 316169 - DNA, 579 bp, Homo sapiens
  misc_feature: GZ8MTXP01D2SOR.19.21.B10.1.454.CMB.2.raw
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (399)..(399): a, c, t, g, unknown or other
  misc_feature (399)..(399): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccaggggacatcgtgatgacccagtctccagactccctggctatgtctctggcgagcgggccaccatcaactgacaagtccagccanaattctttanacagttaccaacaatagaaactactagctgaccagcagagaccaggacagcctccagctgctctatttacngggactagtccgtaaccccgggaagttccccgggggtccctacgacccggtattccgaggtcggacccaggtccggggttctcggggaacngttactttcacttcctaccacctatccagcagccctgcaggctagaagagtcgtaggggtcttaagtttattatntacaaattaatagtttatnttacttcgtggtaacgttcggaccgaaagggttacgtaaaggtggttaacttgttaccaagaccgtaacgtgtcggctcgctaacc

SEQ ID NO: 316170 - DNA, 638 bp, Homo sapiens
  misc_feature: GZ8MTXP01B295I.19.21.B10.1.454.CMB.2.raw
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgacaagtccagccactaattctttanacagttaccaaacaatagaaaactacttagctaggaccagacaagacgaaccaggacacgccctcgtaggctgctactatttacgngggactacgtaccgtaaccccgggaagtccccgggggtaccctacggacccgtattcgaggtcggacacgggtcggggttcgtaggggactaggtactttccactcctaccaccatcagccagcctgcaggctagaacgtgtcggtggggtacttaagtttattagttagtaactaaataaatttaattaatttaacgttacgtttcggtaggttaaccggttcgggaaccggtaaacggggacccgtaaaggggttggaacttagttaccggaagtaccgtaacgtggtcggacgtcggaacctaaccg

SEQ ID NO: 316171 - DNA, 639 bp, Homo sapiens
  misc_feature: GZ8MTXP01BNWFV.19.21.B10.1.454.CMB.2.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagtactctcgtgcacgaccggtgctcgatttagtgtcgtcgcaagagaggagggggggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatcaactgacaagtccagccaataattcttttaanactactaccaaanataactaaactctagtctacgacagacaagacgacgagacacgcctacgagctacgacttatacgttacgcggactacgtacccggtaaccgggtacgtcccgggtacctacgaccgtatcgaggtcgaacgacgggtcggtatagggactagtacttcactctacactatcacgcacgtccgtacgacgagacgtaagaacgtagttcggtacgggtaactttaagtttaacttagttacgtaaactaaattaaatttaagtttaacttacgttaccggttacggtaacgggttaaccgtacgggaaacggtaaacgggttaacgtaaagggtagttaacttcgaacgaacggtaacgtaagtggacgttactcgaacgtaacg

SEQ ID NO: 316172 - DNA, 637 bp, Homo sapiens
  misc_feature: GZ8MTXP01DTMSI.19.21.B10.1.454.CMB.2.raw
  modified_base (248)..(248): a, c, t, g, unknown or other
  misc_feature (248)..(248): n is a, c, g, or t
  modified_base (344)..(344): a, c, t, g, unknown or other
  misc_feature (344)..(344): n is a, c, g, or t
  modified_base (407)..(407): a, c, t, g, unknown or other
  misc_feature (407)..(407): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgagccgggccacatacaactgacaagtccagccaactaattctttanactagttaccaaacaataagaaaactacttagcttaggaccagacaagacgacccgaaggacacgtccctaccgtaggcctgactactatttacgnggactacgtaccgtaacccggggactcccggggtccccctggaccgtattcgaggtcgggacngggcgggtcgtagggacagtactttcacttctacaacatcagcacggcctgaccgaggactaggaagtagttggggtacggtactttaagtttattagtagtaacaaattaatttatttaatttacttacgttcggtaaggttaccgttacgggaacccgttaaaggggtaacctaagggttgaattacgtaacgaaggtaacgtaacgtgggttacgtcgttcgaaccg

SEQ ID NO: 316173 - DNA, 640 bp, Homo sapiens
  misc_feature: GZ8MTXP01D3MVG.19.21.B10.1.454.CMB.2.raw
  modified_base (472)..(472): a, c, t, g, unknown or other
  misc_feature (472)..(472): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagacccctctcgctcacctgtcgccatccgtccggggacagagtcgctagcgactgtgttgcttggcacgtgggtcaggcacgtccccatcggagaggtctagagtgggcgtaggggaagtactagttactttcagtcgtacccaaacgacggttaggaaaacttaaccgtaaaatttagtcgactaaaccctattcgtaggttagaagtacgtacgaactgaaactaatacgaaacgtacgaacaactaacgtaacgaaacgtaacctacgttccnccctagactacgtccttacgtaccctcgtacggtaccgtaccgtacccgggaacggtaccgtacggggttatagttaacgtacgtaagggtaacggaacggtacccggacccctaaagtacgacttacgttcgccctacgttcgtctcggttgtcgttcgttaacggg

SEQ ID NO: 316174 - DNA, 631 bp, Homo sapiens
  misc_feature: GZ8MTXP01D93YW.19.21.B10.1.454.CMB.2.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccgatacgaactgactaagtccagccataattctttanacagttaccaaanaatagaaaactctagctaggaccagcaagacgaccaggacagcctcgtaggctgacttactatttacgcgggactacgttacccgtaacccggggaacgttccccgggggtaccccttacggaccccggtatttaccgaggtcggaccagggtccggggtctaggggacctagtactttcactctacacatcagcagcctgcaggactagaaagtntggtaggggtacttaagtttatagttanaactaaataattattaattacttacgttcggtacggtaacggttacggacggtaaacgggttaacgtaaaggtagttaagttacgttacgaaacgtacgtaagtcggtacgttactaacgaacctaacg

SEQ ID NO: 316175 - DNA, 545 bp, Homo sapiens
  misc_feature: GZ8MTXP01EVB59.19.21.B10.1.454.CMB.2.raw
  modified_base (429)..(429): a, c, t, g, unknown or other
  misc_feature (429)..(429): n is a, c, g, or t
  modified_base (477)..(477): a, c, t, g, unknown or other
  misc_feature (477)..(477): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcctccggggacagagtcgctagcgacagtgtgcttggcacgtgggtcaggcacgtcccccagtccggagtaggtctaggagtggctaggggaaggacatatttcaaattcgtccaaacacgtaggaaataactaaattatcgacacctaatctgttagagagtacgtactagaacaatacaaacgtanaacacaatacgaaacgaacctagttcctacctacgcacgctcgacctntcgttcgaccttcccggaaggacgacgggttgttattaatacgtgtacggagacggccccaagtaacg

SEQ ID NO: 316176 - DNA, 628 bp, Homo sapiens
  misc_feature: GZ8MTXP01EUIBK.19.21.B10.1.454.CMB.2.raw
  modified_base (287)..(287): a, c, t, g, unknown or other
  misc_feature (287)..(287): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccatcgagngtctagaggtggcgtagggaaggactattatttcatcgtaccaacgacgtaggaaactacgaaaattntgacctaaaccgtattcgttaggtttaggaggtacgttacgaacttgaaacaatacgaaacgtagaacaactaagtaacggaaacgtaaacctacgttcctaccctagacgtacggacttacggtacctacgttcgttaccgaccgttacccggaggaaccgtcgggtagttagttacttaggtcggttagggaacgaccggttaccccaaggtacgacgcttaccggtccctaccgttcgtaccgttcgttagggttcgttcgtttaacggg

SEQ ID NO: 316177 - DNA, 627 bp, Homo sapiens
  misc_feature: GZ8MTXP01DECQJ.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcaacaagtacagctgcagcagtcaggtccaggactggtgaacgccctcgcacgaccctctcgctcacctgtcgccatcgtccgggacagagtcgctagcgaactagtgttgcttggcacgtggtcaggcacgtccccatcgagaggtctaggagtggcgtaggggaagactattatttcaaattcgtaaccaaacgtacggtaaggaaaataaacgtaaaattacgtacgaccaacctattcgtaggttagaagtaggtacgactagaaactaaataacaaacgtaacgaacaaactaacgtaacgaaacgtaacctaacgttcctacccgtagacctagtacctacgtacccttcgtcgttaccgtaccgttaccccggaagggtaccggttaacgggttagttaacgttaagttaacgttgggtacgggaacggaccggtaaccccttaagtaaccg

SEQ ID NO: 316178 - DNA, 515 bp, Homo sapiens
  misc_feature: GZ8MTXP01DFZGR.19.21.B10.1.454.CMB.2.raw
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtcgccacggggacatcgtgatcgaccagtctccagactcctggctgtgtctcgtgggcgaggcgggcacgatacgactgactaagcagcanatcttanacactacanananaactactancnacanacanacgacanacacncncncncncnctctatactgcactcgacgacgtcgcncgacatngcgacgcgcgcgngacgatactctctctacacacacacgacacgacgacgacgacgacgacgagtagtagtacggtacttagttattactactaactaataattaattattatacgtacgtacgtaacgtacgacgaacggaacgtaagtagttacgttacacgaagacgtaacgtcgtcgactcgcgtaac

SEQ ID NO: 316179 - DNA, 721 bp, Homo sapiens
  misc_feature: GZ8MTXP01CHAZC.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgaccctctcgctcacctgtcgccagtccgtccggggacaggagtcgctagcgacaggtgtgcttggcacgtgggtcaggcctacgtccccagtccggagtacggtcgtaggacggtcggacgtagggggaaacggactaagttacgtttcgaaacgttcgggttaacccaaacgtaacgggttaaacgggtaaaacttaaacctaaaaaggttttataccgaacctaaaccctaagttaccgttaggtttacggaaaggtaacgtttaccgggaaacttacggaaaccgttaaaacttaaccggaaaacgttaacgaaacctaaacgtaaacgttaaaccggaaaacggtaaaccctacggttacccttacccgttacggactacgtaccgtccgtaacccgttcgtcggttaccgaccgttccccgggaaagtacggttaccgggttattacgttaacgttacgtaaggtacggacgttaccgaacccgttaagtaaccg

SEQ ID NO: 316180 - DNA, 608 bp, Homo sapiens
  misc_feature: GZ8MTXP01ED4TT.19.21.B10.1.454.CMB.2.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtcnccatccgtccggggacaggagtcgcgtagcgactagtgtgcttggcacgtgggtcaggccacgtccccagtcggagaggtctaggaggtggcgtaggggaagtactagttatttcgaatacgtccaaacgacgtaggaaactaacgtaaattatcgacctacctaattcgtaggttagagtaacgtcgtaacgtacgaactaaataccaaacgtacgaacaacgtaactaacgaaacgaacctacgttccttaccgagcacgtctcgacctcgtacgttccgtaccgttaccgaacggtaaccgttagggttcttagttaacgttacgtaacggtacgggaacggttaccggtaaccccaaggtaaccg

SEQ ID NO: 316181 - DNA, 666 bp, Homo sapiens
  misc_feature: GZ8MTXP01EBAEU.19.21.B10.1.454.CMB.2.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccataattctttaanactataccaaanatanaaactntanctagacaganagacgacagacacgcctcgagctcgctactatttacgcgggactacgtaccggtaacccgggtacgtccccggggtacctacgaccgtattcgaggtcggacgtacgggtcgggtacgtacgggaactagtacctttcacttactaccacctactacgacgacgacgtccgtagacgacggtactaggaagtagttggtacggggtactttaaggtttaacttaagttacgtaaactaaacttaatttaaatttacgtttaacgttacgttcgggtaacggtaaccggttaccgggaaaccggtaaacgggttaaccgtaaaggggtacgttaaacgttacgttaacggtaacggtaacgtcggtacggtcgttacgtccgaacctaacg

SEQ ID NO: 316182 - DNA, 577 bp, Homo sapiens
  misc_feature: GZ8MTXP01CSGRN.19.21.B10.1.454.CMB.2.raw
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagccgggccacgatacaactgacaagtccagccanattctttanacagttaccaaactaatacgaaaactactagctaggaaccagcaaggacaccaggacagcctcgtagctgctacatttacgnggcatccgaccggatcggcctgaccgtatcagtcgcaggcggtctgggacagtcttacnctctcacatccagcacgctacgcgacggagtagagtagtgtagggtacgttagtttattagttacgtaactaaacttaattaattaattaacttacgttacggttacggtaacggttacggttacggtaacggaacgtaaggtagttagttacgttacgtaagtaacgtaacgtagtacgttacgtcgcgtaacg

SEQ ID NO: 316183 - DNA, 634 bp, Homo sapiens
  misc_feature: GZ8MTXP01EVD90.19.21.B10.1.454.CMB.2.raw
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
  modified_base (392)..(392): a, c, t, g, unknown or other
  misc_feature (392)..(392): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccactaattctttaanactatacaanaatanaaactatanctagacaganagacaccaggacacgtcctcgtagctgctactatttacgnggacctacgttacccggtaacccggggtacgtcccggggtacccctacggaccgtagtccgaggtcggacgngggtccgggtacgtacgggactagttctttacaccttcctacaccagtccagcacgcctcgcgacggtcaggaagtgtggggtagtacgtttagtttacttagttacgtaactaaacttaaatttatttaattacgttacgtcggtaaggttaccggttacgggaaccggttaaacgggtaacgtaagggttacgttattaacgtaacgtaacggtaacgtacgtaggttcgtccgttcgtc

SEQ ID NO: 316184 - DNA, 627 bp, Homo sapiens
  misc_feature: GZ8MTXP01AJF1V.19.21.B10.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggccgggccacatacaactgacaagtccagccaataattctttanactattaccaaacaatacgaaaactntagctaggaccagacagaacgaccgaggacacgcccctacgtaggctgctactagtttacgngggactacgtccgtaacccgggacgtcccggggtacctcggaccgtnttcgaggtcggacagggtcgggtctacggggactagtactttccacttcctaccactacgcgacgcacggtccacgccgaggctaggaaagngttgggngggttaactttaggtttattagttactaacctaaattaatttactttagttaacttccgttaggtcggtaacggttccggaacggtaaacggacgtaaggtagttattacgacgtaacgacgtaacgtggcgactcgaaccgtaacg

SEQ ID NO: 316185 - DNA, 720 bp, Homo sapiens
  misc_feature: GZ8MTXP01CCXA6.19.21.B10.1.454.CMB.2.raw
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtaccggganagagtcgctagcgacgtagtgttgcgttggcacgtgggtcaggcacgtccccagtcgagaggtctaggagtggcgtagggaagactattatttcagttcgtaccaaagtacgtaggaaactacgtaaatttancgacctaaacctattcgtagttacgaagtacgtaccgaacttacgaactaaatacgtaaacgtaagaaaccaacgtaacgtaaccgtaaaacgtaaacccgttaacggtttccccgtacccttacgggacctaacggttacccgttacggttaaaccccgtttcgtaccgggttaccgtaaccccgttaccccgggaagggtaaacccggtaccggggttaacgtttaaagttaacgtttaacggtaacgggttaacgggaaaccggtaccggaccccctaaaggtaacgaaccgttacttccgaaccccgtaacttcccggttactccgttagggtccgttaacgtttaaccggg

SEQ ID NO: 316186 - DNA, 576 bp, Homo sapiens
  misc_feature: GZ8MTXP01DZWLQ.19.21.B10.1.454.CMB.2.raw
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
  modified_base (533)..(533): a, c, t, g, unknown or other
  misc_feature (533)..(533): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctgcagaccctctcgctcacctgtcgccagtccgtccggggacagacgtcgctacgcgaacnggtgtgcttggcacgtggtcaggcacgtccccagtcgagtacggtctagaggtggcgtagggaaggactagttatttcaattcgtccaaacgacgtagaaataacaaaattnacgacacctatcgtagttagagtacgtacgactagaacaaagtacaaacggtanaacaacgtaacgtacgaaacgtaaaacctgttaccctccctagactnacttcgacctcgtcgttacgaccgttcccggaagaccgttacgggttnttattaagttacgtggaggaacgaccgtaaccccgaagtaacg

SEQ ID NO: 316187 - DNA, 704 bp, Homo sapiens
  misc_feature: GZ8MTXP01CNTXX.19.21.B10.1.454.CMB.2.raw
  modified_base (636)..(636): a, c, t, g, unknown or other
  misc_feature (636)..(636): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacaggagtcgctagcgactagtgtgcgttggctacgtgggtcacgggcacggtccccagtcggagaggtcgtaggagtggcgtaggggaaaggtactagttaactttcaagttacggtaacccaaacgtaaccggtagggtaaaacttaaacctaaagtttacgacgacctaaccctacgttacgtaggtttacggaaaggtacggttaccgtaacgttacgaaacctaaattaaccgtaaacggtaacgaacaacgtaaaggtaaccgtaaacgtaaacctacgtttaccctacccgttacgcctaacggtccttacgacccgttcgttacggttaccgtaacccgttaccccgggaaacgggtaccggttaaccggggttnttaacgttaaacgtttaccgttaagggttaacgggtaacggacccgggtaacccccgaagttaaccgg

SEQ ID NO: 316188 - DNA, 700 bp, Homo sapiens
  misc_feature: GZ8MTXP01AJO17.19.21.B10.1.454.CMB.2.raw
  modified_base (226)..(226): a, c, t, g, unknown or other
  misc_feature (226)..(226): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgtaccctnttgctcacctgtcgccagtccgtccggggacaggacgtcgctaggcgactaggtgttgcttggctacgtgggtccaggccacgtccccagtccggaggtaggtcaggaggtgggacgtaggggaaagtctattacgtttcaaacgttcgtaacccaaacgtacggttaaggaaactaacgtaaattactcggacctacgtaagttcgtaggttacgaggtacgtacgtactacggaaactaaacgttacgaaacgttaacgaacctaacgtaacgttaaccgaaaacggtaaaccctggtttacccctacccgtacgaccgtacgggtacctacgtaacccgttcgtacgggttaccgaaacccgttcccggggaaacggttccgttaccgggggtttattaacgtttaacgttaaccgggtaacgggttaacggggaaccggttaacccgggtaaccccttaagttaacccgg

SEQ ID NO: 316189 - DNA, 606 bp, Homo sapiens
  misc_feature: GZ8MTXP01D21PA.19.21.B10.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
  modified_base (493)..(493): a, c, t, g, unknown or other
  misc_feature (493)..(493): n is a, c, g, or t
  modified_base (524)..(524): a, c, t, g, unknown or other
  misc_feature (524)..(524): n is a, c, g, or t
  modified_base (570)..(570): a, c, t, g, unknown or other
  misc_feature (570)..(570): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccaccgatacaactgacaagtccagccanaattctttanacagttaccaaanaatanaaaactctagctggacagcaagacgacaggacacgcctcgtaggctgactataatttacgngggactaacgttccgtaaccccgggtagtccccgggttaccctagaccgtattcgaggttcggaaccgaggtccgggtacgtacgggaacctagtactttcactctacacctatcagcacgtccctgacaggtcaagaagtagtcggtaggacttagttttatagttanactaaataatttattattacgttacttcggnggtaacgttcggaaccggtaagggttaaccgtaagggtgttaattnacgaagtaaccgtaatggtcgactcgttccgtaacc

SEQ ID NO: 316190 - DNA, 639 bp, Homo sapiens
  misc_feature: GZ8MTXP01DVS5E.19.21.B10.1.454.CMB.2.raw
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (608)..(608): a, c, t, g, unknown or other
  misc_feature (608)..(608): n is a, c, g, or t
  modified_base (621)..(621): a, c, t, g, unknown or other
  misc_feature (621)..(621): n is a, c, g, or t
tcagtactctcgtgcacgaccggtgctcgatttagtgtcgtcgcaagagaggagggggggaccagggcagtcaccagagctccagacaatgtctgtctccttcctcttcttcctgcccgtgctgggccctcccacaaggtgtcctgtcacaagtacagctgcagcagtcaggtccaggactgggtgaacgccctcgccagacccctctcgctcacctgtcgccatcgtccgggganagagtcgctagcgactagtgttgcgttggctacgtgggtcacggctacgtccccagtcggagtaggtctaggnggtggcgtaaggggaacgtactagtttactttanacgttacggtacccaaacgtacggtaagtaaacttaactaaaagtttacacgacctaaacctattcggtgtttagaaacggtacgtacggtaacgtagtaaacctaaagtaccgtaaacggtaacaaccaaacgtaacgtaacgaaacgtaacctcgtcccttcccgagctacgctacgtaccgttcgtacggtacacccgtccggaggttaccgagggttctatacgtacgtggtacggacgtacccgccgaatcgacttcgcncccgtactcgtcnttgggtcttaacgtaagg

SEQ ID NO: 316191 - DNA, 573 bp, Homo sapiens
  misc_feature: GZ8MTXP01AZCS3.19.21.B10.1.454.CMB.2.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatacaactgacaagtccagccacaattcttttaanactactaccaanaagtanaaactatagctagacagacagacgacgagacacgcctcgagctgactctattacgnggactacgtaccgtaccggtacgtcccgggtaccctacggactagtcgagtcgcgnggcgggtgacgggactagtacttacactcacacatcagacacgctcgcgagagtagagtagtaggtgtacgttagttagttattacgtactaactaattaattattacgttacgttacggtaacggtacggttacggtacggaacggtaacgtaaggttagagttacgtaagacgaacgtagtgttacgtcgcgtaac

SEQ ID NO: 316192 - DNA, 802 bp, Homo sapiens
  misc_feature: GZ8MTXP01DHQS0.19.21.B10.1.454.CMB.2.raw
  modified_base (250)..(250): a, c, t, g, unknown or other
  misc_feature (250)..(250): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgacggccggccacatacaactgacaacgtccagccaactaattctttaanactacgttaccaaactaatacgaaaactctagcttaggaccagcaagacgaccaggacacgccctccgtaggctagccttacgtaattttacgcgggacctaacgtttccccggtaaaccccgggggaacgttcccccggggggttaccccccttacggaaccggttacgtttaccggaacggggtccgggaccgtaacgggggtcccgggggttttcgaacgggggaacccttaaagggtctttttacccaaccgttcttaccaaccaacgttcaacggtccaacggtcccgtacgaccggtacggtcgtaaaggtaacgtacggttacgggggttaacggttaacgttttaagttttaacgtttaacgttaacggtaaactaaaactttaaagtttaacttttaaacgtttaaaccgtttaccggtttacgggttaacggttaaacccggttaccgggtaaaccggttaaacgggtaaaccggttaagggttacgttacttaacggtaacggaaacgttaacggtacgtggttacgtcgttaacggaacc

SEQ ID NO: 316193 - DNA, 537 bp, Homo sapiens
  misc_feature: GZ8MTXP01AON08.19.21.B10.1.454.CMB.2.raw
  modified_base (267)..(267): a, c, t, g, unknown or other
  misc_feature (267)..(267): n is a, c, g, or t
  modified_base (341)..(341): a, c, t, g, unknown or other
  misc_feature (341)..(341): n is a, c, g, or t
  modified_base (424)..(424): a, c, t, g, unknown or other
  misc_feature (424)..(424): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagaccctctcgctcacctgtcgccagtccgtccggggacagacgtcgctagcgacagtgttgcttggcacgngggtcaggcacgtcccatcgagaggtctagagtggctgggaagcatattcatgtcaagacgtgaactacaattngcaaccatctgtagagagtcgatgaacactacaacgtagacacagtacgaaacgaccagttacctccctgacagctcgacctncgtacgaccgtcccggaggtacgacgggtagtataacttcgnggtaggaacgccggaccccaagtacgacngttcgaacccacctcgtcgtcttcgggtaacttcgttaacgg

SEQ ID NO: 316194 - DNA, 591 bp, Homo sapiens
  misc_feature: GZ8MTXP01BCTVQ.19.21.B10.1.454.CMB.2.raw
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
tcagtactctcgtgcacgaccggtgctcgattttagtgtcgtcgcaagaggaggaggggggcagagtctgctgaattctggctgaccagggcagtcaccagagctccagacaatgtctgtctccttcctcttcttcctgcccgtgctgggcctcccanaaggtntcctgtcacaagtacagctgcagcagtcaggtccaggactggtnaagccctgcagaccctntcgctcactgtnccatctcggggacagagcgctagcgacagtgttgcttggcactgggcagcagtccccatcgagaggtctagagtggctcggaggaanatattanaatacgtcaacaacgtagaataactaaatatanacacactactgtagagagtacgtactagaacaactaacgtaaacgtaacgaaacgtaactaacgtaacgaaacgaaaccgtaacgttaccgttacccgtacgacgtacgtacgtacgtaccgtaaccgttacgttacgtaccgttacccggaacgggtaacggttaacgggttacgttaagttaattacgttaacggtaggaacggaccggtaacccgaacgtaacg

SEQ ID NO: 316195 - DNA, 655 bp, Homo sapiens
  misc_feature: GZ8MTXP01BOWB7.19.21.B10.1.454.CMB.2.raw
  modified_base (248)..(248): a, c, t, g, unknown or other
  misc_feature (248)..(248): n is a, c, g, or t
  modified_base (455)..(455): a, c, t, g, unknown or other
  misc_feature (455)..(455): n is a, c, g, or t
  modified_base (604)..(604): a, c, t, g, unknown or other
  misc_feature (604)..(604): n is a, c, g, or t
tcagtactctcgtgcacgaccggtgctcgatttagtgtcgtcgcaagagagagtaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgaggccgggccaccatccaactgacaacgtccagccaactaattcttttaanactacgttaccaaactaatacgaaaactacttagcttaggaccagacagacgaccaggacacgcctcgtaggctgctctattacgtggactacgtccgtaacccgggagtccccggggtcccctaggaccgtagttaccgaggtacggccgtaacgggtcgggtcgtagggacctagttcttacacctctacacatcagcacgtccngaccgagtcgagaagtgtggggtacgtacgtttaagtttacttagtacgtaactaaagttaatttaagtttattaacgttaccggttcggttaacgggtacccggttacgggaacccggttaaaggggtaaccgtaaggggttaggttnttacgtaacggtaaagaaccgtaaggttggacggtaaccttcggtaacccg

SEQ ID NO: 316196 - DNA, 663 bp, Homo sapiens
  misc_feature: GZ8MTXP01DWQEF.19.21.B10.1.454.CMB.2.raw
  modified_base (297)..(297): a, c, t, g, unknown or other
  misc_feature (297)..(297): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgcctcacctgtcgcctagtccgtaccggggacagagtcgctagcccgatagtgttgcgttggcacgtgggtcaggcacgtcccatcggagngtacgaggagtggcgtagggaagtactattattttacagttacggttaccaaacgacggttaggaaactaactaaaatttagtacgaccaaacctagttcgttagttagaggtacgtacgactacgaactaagtacgaaacgtacgaacaacgtactaaaccggaaacgaaccttacgttacccttacccgagtaccacgtcggtaccgtaccgttcgtaggtccgtaaccccgtccggaacgggtaacgtacgggttagttaacttacgttacggtaaggttacgggaacggtacccggacccctaaagtacacgttacgttccgccctaccgtcgttcgtcggttcgttaacgttaacttaagg

SEQ ID NO: 316197 - DNA, 695 bp, Homo sapiens
  misc_feature: GZ8MTXP01AZZUH.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttctcctgccgtgctcggcctccacaaggtgtcctgtcacaagtacagctgcagcagtcaggtccaggactggtacgaacgccctcgcacgaccctctcgctcacctgtcgccatccgtccggggacaggagtcgctacgcgactaggtgttggcgttggcctacggtgggtcaggccacgtcccccagtcggagtaggtacgtaggaggttggcggtaggggaacggtactaagtttacttcgtaaacttacggtaacccaaacgtacgggtaacggtaaacttaaactaaacgtttagcgtaccctactaacttcgttagttaggagtacggtacgaacgtacgaacaacgttaccgaaacgttacgaaccgtaacaacgttaacgaaaccggtaaccttaacgttcccgtcccgtacgacgtacgtaccgtacgtacccgtcgttcgttccggtaacccgttccgggtaaacgggtaacggttacggggttacggttaacgttaacgtttaccggtaagggttaacgggaaccggttacccggtaaccccgttaagtaacccgg

SEQ ID NO: 316198 - DNA, 661 bp, Homo sapiens
  misc_feature: GZ8MTXP01B44HZ.19.21.B10.1.454.CMB.2.raw
  modified_base (371)..(371): a, c, t, g, unknown or other
  misc_feature (371)..(371): n is a, c, g, or t
  modified_base (556)..(556): a, c, t, g, unknown or other
  misc_feature (556)..(556): n is a, c, g, or t
  modified_base (619)..(619): a, c, t, g, unknown or other
  misc_feature (619)..(619): n is a, c, g, or t
tcagtactctcgtgcacgaccggtgctcgatttagtgtcgtcgcaagagaggagggggggaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgtcgccatccgtaccggggacagagtcgctagcgactagtgttgcttggcacgtgggtcagggccacgtccccaagtcggagtaggtctaggagtgggcgtagggggaagactatatttcatgtacccaaagacggtaggaaacttaacaaatttntacgacaaaccgtaatcgtagttagagtagtacgactaggaactaagttacgaaacggtagaactaacaagttaaccgaaacgtaacctacgttcctacccctaggacctacggtaccttacggtaacccctttcggtacgtaccgtaaccccgttccccgggaagggtaaccgtacgggggttnttaacttaacgttcgttaagggaacgttaaacgggacccggacccctaaaggtaccaacgttnttccggccctaccgtcgtctcggttgtcgttaacgttaaggg

SEQ ID NO: 316199 - DNA, 718 bp, Homo sapiens
  misc_feature: GZ8MTXP01DQJI1.19.21.B10.1.454.CMB.2.raw
  modified_base (483)..(483): a, c, t, g, unknown or other
  misc_feature (483)..(483): n is a, c, g, or t
tcagtactctcgtgcacgaccggtgctcgatttagtgtcgtcgcaagagaggagggggggaccagggcagtcaccagagctccagacaatgtctgtctccttcctcttcttcctgcccgtgctgggccttccacaaggtgtcctgtcacaagtacagctgcagcagtcaggtccaggactgggtgaacgccctcgcacgaccctctcgcctcacctgtcgccagtccgtccggggacagagtcgcgtagcgactagtgtgcgttggcacgtgggtcaggccacgtccccagtcggaagtaggtacgtaggtaggtgggacgtagggggaaacgtactaagtttactttacgagttacgtacccaaacgtacggtaagtaaacttaaactaaagttagtaccgaccaaacccttattccgttagggtttaggaaacggtacggtacgtacgtacgaaacctaataccgaaacgtagaaaccaanaagttaaccggaaactaaacccttcgttaccctaccgtacgacctacggtacgttaccgtacccttcgtacggtaccgaccccgttaccggggaaggtaacccgggttcggttacgttaactttaacggtaccgggtaagggtaaacgggaaacccggtacccggaaccctagggtaacgaaacttcgttacccggccctaccttcgtactcggttagttcgttaacgttaaggg

SEQ ID NO: 316200 - DNA, 621 bp, Homo sapiens
  misc_feature: GZ8MTXP01DRRVK.19.21.B10.1.454.CMB.2.raw
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
  modified_base (444)..(444): a, c, t, g, unknown or other
  misc_feature (444)..(444): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggcgggccacgatcgaactgacaagtccagccataattctttanacattaccaaanaatagaaaactcttagcttaggaccagcagacgacaggacagcctacgtagctgctatatttacgnggctacgtaccgtacccggggactcccggggtaccctcgacgtntcgagtcggctgggcggtcgtagggactaggtactttacactcctacaaccacacagacacggccctgacgacggntagaaagtgtggggtcggtattaagtttaccttataccgtaataacttaaattatttaattacttaccgttggtaacgggtaccgtttacgggaacccgttaaaggggtaacctaagggttcgttattaaccggttaagaacgtaaccgtaaagttcggttagggtcttcggtaacc

SEQ ID NO: 316201 - DNA, 666 bp, Homo sapiens
  misc_feature: GZ8MTXP01BDN86.19.21.B10.1.454.CMB.2.raw
  modified_base (155)..(155): a, c, t, g, unknown or other
  misc_feature (155)..(155): n is a, c, g, or t
  modified_base (257)..(257): a, c, t, g, unknown or other
  misc_feature (257)..(257): n is a, c, g, or t
  modified_base (614)..(614): a, c, t, g, unknown or other
  misc_feature (614)..(614): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgccgtgctcggcctcccanaaggtgtcctgtcacaagtacagctgcagcagtcaggtccaggctggtcgaacgccctcgacacgaccctctcgctcacctgtcgccagtccggtccggganaggacgtcgcgtaggcgtacgtaggttgtcgtcgttaggccgacggtgggtacacgggacctaccggtaccccagtaccggaaggtacggtacgtaggtaggtcggacgtaggggaagtactagttatttcgaacgttacgtaaccgaaagtacgttaaggaaacttaaacgtaaattacgtacgacctaactagttcgtaggtacgtaagacggttacaactagaaacctaagtacgaaacgtacgacaataagtaaccggaaacttaaccgtgttaccccgttgaggcccctagtaccgtccgtaacctcggttaacgccggtaacccgttacggtaaaggtaccgttagggttnttacgtaaagttccgaagggtaacggaccgacccggtaaccttaagaacccg

SEQ ID NO: 316202 - DNA, 623 bp, Homo sapiens
  misc_feature: GZ8MTXP01C64RC.19.21.B10.1.454.CMB.2.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagtactctcgtgcacgaccggtgctcgatttagtgtcgtcgcaagaggaggaggggggggtacaacaggcaggcagtggcagcaagatggtgttgcagacccaggtcttcatttctctgttgctctggatctctggtgcccaggggacatcgtgatcgacccagtctccagcctcctggctgtgtctcgtgggcagcgggccacgatcaactgacaagtccagccatattctttanactagttaccaanatagaaaactctagcttagaccagacagacgacctaggacacgcctcaggctgctctatttacgnggcagtaccgtaccggatccgggcccctgactntcaggtcgacnggcgggtntagggatgtacttcacttcacacatcgaactcgacgtcgagacgtacgagaagtagtggtacggtacgttaacgtttaagttaacttagtaacgtaaacttaaagtttaattaacgttacgttaacgttaccggttacggttaacgggttaaccggttaaccgggtaaacgttaacgggtaaacggtaggttacgttacgttaaacggtaacgtaacggtaacgttacggtcggttacgtccgttaacgtaaccg

SEQ ID NO: 316203 - DNA, 684 bp, Homo sapiens
  misc_feature: GZ8MTXP01BCJTO.19.21.B10.1.454.CMB.2.raw
  modified_base (261)..(261): a, c, t, g, unknown or other
  misc_feature (261)..(261): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgtgctggcacgngggtcaggcacgtcccatcggagaggtctaggagtggcgtagggaagactatactttcagtcgtaccaaactacggtaggaaactacaaattntcgacctaaccattcgtgttagagtacgtacgacgtacgaactaagttacgaaaccgtagaacctacaagttaaccgaaaacggtaacccttacggtttcccaccccgtaggacctaacggccttacgtaacccgttcgtaacggttaccgaaccccggttccccggaaaggtaaccgtaccgggggtttagtaaatttacgttaacggtaagggttaacgggaaaccggtaccccgggacccctaaagttaacccggaattaccggttccgtaaccccgttaccgttcccgtcgtttcccgggttaggtccgttaacgtttaaacgggg

SEQ ID NO: 316204 - DNA, 618 bp, Homo sapiens
  misc_feature: GZ8MTXP01CB9YX.19.21.B10.1.454.CMB.2.raw
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
  modified_base (569)..(569): a, c, t, g, unknown or other
  misc_feature (569)..(569): n is a, c, g, or t
tcagtactctcgtgcacgaccggtgctcgatttagtgtcgtcgcaaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtcgcccagtccgtaccggggacaggacgtcgctagccgacaggttgttgcgttggctacgtgggtcaggcacgtccccagtccgagnggtctagagtggcgtaggggaaggtactattagtttcaaagttcgtccaaacgtaccggtaggaaactaactaaattnacgtactacctaattcgtagttagagtacgtcgaactacgaaactaactacgaaacgtaacgaaccgtaacaagtaccgaaacgaacctaacgttcctaccgtcgcaagtcctacggcccttaactcggttcgtaaccgttacccggtaagggacttaacggggttnttaacgttaattaccgtggtaacgggacgaccggccccttaagtaaccg

SEQ ID NO: 316205 - DNA, 771 bp, Homo sapiens
  misc_feature: GZ8MTXP01CGBE1.19.21.B10.1.454.CMB.2.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagaggagggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacngtgtgctggctacgtggcaggcacgtccccagtccggagtacggtacgtaggaggtcggggacgtagggggaaacggtactaagtttagttttacgacgtttaccgtaaccgaaaccgtaacggttaaggtaaaacctttaaactaaaagtttagtaccggaccctaaaacccttagtttcgttacggtttacgggaaggtacggtaccgtaacgttacggaaacctaaacgttaccgtaaacggtaacgaacctaaacgtaacgtaaccggtaaaacgtaaacccgttacgtttaccctcccgttacgaccgttaccggtaccgttcggtaaccccgtttcgttacgggttaccgaacccggttaccccgggaagggttaaccggtacggggttatttaacgttaacgtttacggtaagggttaaccgggacgtaacccggacccctaaagtacgttaacgttcgttacccgtccccgttaccttccgggttaccttcggttcggtcgttaacgttaaggg

SEQ ID NO: 316206 - DNA, 643 bp, Homo sapiens
  misc_feature: GZ8MTXP01AE8MH.19.21.B10.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccacgatcaactgacaagtccagccataattctttaanacagttaccaaanaatagaaaactctagctggtaaccngcagacgaccnggacagcctctaggctgctctatttacgnggactacgtaccgtaaccggacgttccccggggtacctacggtacccggttcaggtcggcgtaacgggtccgggtcgtacgggactagtactttcactcctaccgaccatcaacgcacgtcctagacgaggtcgtagaagtagtacgtacggtacggttagtttaagtttagttaacgtaactaaactaaattaatttattaacgttacgttacggttacggtacggtaacggtaaccggttaaacgggtaacgaacgggtaaggtaagttacgttacgttaacgtaacgtacgtaacgtcggtacgttacgtaacgaacgtaac

SEQ ID NO: 316207 - DNA, 668 bp, Homo sapiens
  misc_feature: GZ8MTXP01DLYXK.19.21.B10.1.454.CMB.2.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (610)..(610): a, c, t, g, unknown or other
  misc_feature (610)..(610): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcgttcctgcccgtgctgggcctcccacaaggtgtcctgtcacaagtacagctgcagcagtcaggtccaggactggtgaagcctgcacgaccctctcgctcacctgtcnccagtccgtccggggacagagtcgctagcgacagtgttgcttggctacgtggcaggcacgtcccagtcgagnggtctaggagtggcgtacggggaaagactagtatttacaagttcgtcccgaaatacggtaggaaattaactaaaagtttacacgtactaaccgtaattcgttaggttagaaggtacgttacgaacgttacggaaacctaaagtaaccgtaaacggttaacaaactaacgtaaacgttaaccggaaaacggtaaaccctacgtttacccgtaccccgttagaccgtaacggtccttaccgtaacccgttcgtacggttaccggtaacccgttaccgggtaaacggtacggttacggggttnttaacgttaacgttacgtaaggtaacgggaacgaccggtaaccccgttaagtaaccgg

SEQ ID NO: 316208 - DNA, 550 bp, Homo sapiens
  misc_feature: GZ8MTXP02H4HQH.19.21.B10.1.454.CMB.2.raw
  modified_base (451)..(451): a, c, t, g, unknown or other
  misc_feature (451)..(451): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctcgcacgacccctctcgctcacctgtgccatccgtccggggacagagtcgctagcgacagtgttgcttggcacgtggtcaggcacgtccccatcgagtaggtctagagtggctggggaagactatatttcattcgtccaaactacggtggaaataactaaattatagacctacattctgttagagtagtcgactgaacctatacaaacgtagaacacagtacgaagtaacctagttaccnccgtgactagctcgtacctcgtagtcgacctcccggaaggtaccgacggggttctagttaagttacgtaggtacggaagacccggtacccctagaaccg

SEQ ID NO: 316209 - DNA, 588 bp, Homo sapiens
  misc_feature: GZ8MTXP02HJ6RC.19.21.B10.1.454.CMB.2.raw
  modified_base (323)..(323): a, c, t, g, unknown or other
  misc_feature (323)..(323): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtggtcaggcagtccccatcgagaggtctagagtggctagggaaggacatatttcatgtaccaanacgtaggaataacaaattatgacaacctatctgttagagtagtcgactagaacaatacaaacgtagaacaacagtacgaaacgaacctagttacctcccgtagacaacgcttacgtacctccgtggtaccgaccgtaccccggaaggaccgtacggggttattaatagttaacgtggtaacgggaaacggaccggaccccctaattaacgaccacgttaccgaaccctaaccgttccggttcctcgttcggacgttaccttaagg

SEQ ID NO: 316210 - DNA, 637 bp, Homo sapiens
  misc_feature: GZ8MTXP02GMEAL.19.21.B10.1.454.CMB.2.raw
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
tcagtactctcgtgcacgaccggtgctcgatttagtgtcgtcgcaagaggtaggaggggggaggtacaacaggcaggcaggggcagcaagatggtgttgcagacccaggtcttcatttctctgttgctctggatctctgggtgcccgacggggacatcggttgatgacccagtctccagactcctggctgtgtctcgtggggcgaggcggggccaccgatcgaactggccaagtccagccacaatcttttaanacacgttaccaactaatanaaactacttagcgttagtacagcacgagaccaggacgacgcctcgaggctgctactaatttacgnggactacgtccgtaaccgggacgtcccggggtacccctaggaccgtattcgaggtcggacgtcgggtcggtcgtagggacagtacttacaactcacaacactacacgtacacgtcctagacgaggactaggaaacgtagtaggtcggtacgttaagtttaagttacgttacgtaactaaacttaatttaatttagtttacgtacgttcggtacggttacggttacggaaaccgtaaagggaaccgtaagggtcggtaattacgtaacgaacgtaacggtaacgtcgtacggtcgtacgac

SEQ ID NO: 316211 - DNA, 666 bp, Homo sapiens
  misc_feature: GZ8MTXP02JO54Q.19.21.B10.1.454.CMB.2.raw
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagtactctcgtgcacgaccggtgctcgatttagtgtcgtcgcaaggagagaggaggtacaacaggcaggcaggggcagcaagatggtgttgcagacccaggtcttcatttctctgttgctctggatctcgtggtgcccacggggactatcgtgatgacccagtctccagactccctggctgtgtctcgtgggcaggcgggcctacgatcgaactgacaagtcagccacatctttanacatccaanatanaaactntagcttagacagcagacgaccagactacgccgtacgaggctgcttacgtatttacgtggtactactaccgtaaccgggtacgtcccggggtacccctagaccgtattcgaggtcggcgtcgggtcgggttcgtaggggaactagttactttccacttcctaccaacctagtacgaacgaccgacgtccgtacgaccgtacggtctagaaagtagttacggtacgggtacttaagtttaacgttacgttacgtaaccgtaaacgttaagtttaagtttaacttaacgtttacgtttacggttaacgggtaccggttaccggaacccggaaaggggtaaccgtaaacgggttacggtaacttaacgtaacgaaacggtaaccggtaacgttcggtacggtacgtacgtacc

SEQ ID NO: 316212 - DNA, 644 bp, Homo sapiens
  misc_feature: GZ8MTXP02I3N1J.19.21.B10.1.454.CMB.2.raw
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaatagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccacaattctttanacagttaccaaacaatagaaaactacttagcttaggaccagcagacgaccaggacagcctcaggctgctcatttacgnggctacgtccgtaaccccggggtaatccccggggtacccccctggaacccgtattccgaggtcggcaggggtccgggtacgtaggggacctaggtactttccgactcctccaaccatcagcagccctagcgtagggctagaaagtagtggtcgggtacttaggttttattagttacgtaactaaacttaaattaactttaattaacttacgttacggttagggtaaccgtttaccgggaccgtaaaacggggtaaccgtaaaggggtacggtaacttaagtaacgaaggtaacgtaaacggtggtacggttacacgtaacccg

SEQ ID NO: 316213 - DNA, 575 bp, Homo sapiens
  misc_feature: GZ8MTXP02I9WIF.19.21.B10.1.454.CMB.2.raw
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggcacgtccccatccggagnggtctaggacgtggctaggggaagactagttactttcattcgtccaaactacggtaggaaacttacaaaatttacacgaccaacctattctagttagaagtagtccgaatgaacatacgaaacgtagacactagtacgaaacgaacctagttacctacctagacacgtcctagaccctntcgtacgaccgtcccgaaggtaccgtacggggttataacgtaacgttacgtacggtaggaaaacgccggtacccctaagtaaccg

SEQ ID NO: 316214 - DNA, 742 bp, Homo sapiens
  misc_feature: GZ8MTXP02F2Y0N.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagagtcgctacgcgacaggtgttgcttggcacgtgggtcaggccacgtccccagtcgagaggtctaggagtggcgtaggggaacgactaattactttcaagttacgtacccaaacgtacggtaaggaaaacttaaaccgtaaaaatttataccgaacctaaccctaagttaccgttaggttaggtaaggtaacggtaccggtaaacttacggaaacctaaaactaccgtaaaaccggttaaacgaaaccaaaccgtaaacgttaaccggaaaaccgtaaacccgttaaaccggtttcccttacccgttacggaccaacgtaccgttacggaacccttaccgttcgggtaaccgtacccgtaaccccggggaaacggtaaccgggtaaccggggtttacggttaaatttaaaccggtttaacggttacggggttaaacgggggtaaaaccggtaacccgggaaccccccgttaaaggttaaacccgg

SEQ ID NO: 316215 - DNA, 642 bp, Homo sapiens
  misc_feature: GZ8MTXP02FK6WA.19.21.B10.1.454.CMB.2.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagaggagggggggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgagccgggccacatcaactgacaagtccagccactaattctttanactagttaccaanaatacgaaaactactagcttgtaccagacagacgaccaggacagcctcgaggctgctctatttacgngggcacgtccgtacccggggagtccccggggtcctacggaccgtatcgaggtcggcgacgggtccggggtcgtaggggacctagtactttcgactctacaccatcacgcacgcctgacgaggctagaagtagtggtggtacttagtttaattagttacgtaacctaaacttaattaatttaatttaacgttacgtttcggtacggtaaccggtttaccggaaccggaaaacggggtaccgtaacgggttaggtaacttaagtacggaaacgtaacggtaaaccgttcgggtacggtaccgtacggacccgtaacccg

SEQ ID NO: 316216 - DNA, 654 bp, Homo sapiens
  misc_feature: GZ8MTXP02HINK5.19.21.B10.1.454.CMB.2.raw
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacaggagtcgctagcgacagtgttgcttggcacgtgggtcaggcacgtccccagtcgagaggtctaggagtggcgtagggaaggactagttaactttcgattcggtaccaaacgacggtaggaaactaactaaaagttactgaccaaccattccgtgttagaagtagtaccgacgtagaacaactacaaacgtagacaactagacgaacgaaactacgttacctcccgtgacacggtactacggtacccttcgtacggtacgtacccgtaacccggacggtaaccggtaacgggggttattaaacgttacgttaaccgttagggtacgggtaaacggtaccgggacccccttaagtaaccggacgtaacttccggaaccctaaccgtccgttacccgttaggtccggttcggtacctttaacgg

SEQ ID NO: 316217 - DNA, 647 bp, Homo sapiens
  misc_feature: GZ8MTXP02JSOZ1.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtgcttggcacgtgggtcaggcacgtcccagtcgagaggtctaggaggtggacgtaggggaagactagttatttcagttcgtccaaacgtacgtaggaaataacgtaaattacgtacgactactatacgttggttagagtacgtcgacgttagaactaactacgaaacgtagaaccaacaacgtaacgaaacggtaaaccctaacggtttaccctaccccgttacgacgtaccggtaccgttaccggtaacccttcgttacggtaccggtaacccgttaccccgggaacgggtaaccggtaccgggggttaataacgtttaacgttaccgttaggtaacggggtaacggacccgggaccccctaaggtaacccg

SEQ ID NO: 316218 - DNA, 638 bp, Homo sapiens
  misc_feature: GZ8MTXP02G29BQ.19.21.B10.1.454.CMB.2.raw
  modified_base (246)..(246): a, c, t, g, unknown or other
  misc_feature (246)..(246): n is a, c, g, or t
  modified_base (333)..(333): a, c, t, g, unknown or other
  misc_feature (333)..(333): n is a, c, g, or t
  modified_base (397)..(397): a, c, t, g, unknown or other
  misc_feature (397)..(397): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccactaattcttttanactagttaccaaacaatacgtaaaactcttagcttaggaccagcaagacgaccaggacacgcctacgtaggctgctactatttacgngggactacgtaccgtaccccggggaacgtcccggggtccccctagaccgtattcgagtcggacnggggtcgggtacgtggggaccagttactttccacttcctcaacccatccgagccacgtcccgtgaccgtaggcctaggaaagtgttggtcgtacgtttagttttattaagttctaactaaataatttaatttattaagttacgttcggtacggtaccggttcggaacgtaaacggggtaaccgtaagggtacgtaattagaacgtaaggaaccggtacgtggtacggtacttacggaaccc

SEQ ID NO: 316219 - DNA, 630 bp, Homo sapiens
  misc_feature: GZ8MTXP02GFBPP.19.21.B10.1.454.CMB.2.raw
  modified_base (360)..(360): a, c, t, g, unknown or other
  misc_feature (360)..(360): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (628)..(629): a, c, t, g, unknown or other
  misc_feature (628)..(629): n is a, c, g, or t
tcagtactctcgtgcacgaccggtgctcgatttagtgtcgtcgcaagagaggagggggcacttctccctctaacactctccccagtctccagacctccctggctgtgtctctgggcgagcgggccaccatcaactgcaagtccagccacaatcttttatacagttccaacaatgaaaactacttagcttggtaccagcagagaccaggacagcctcctaggctgctcatttacgtgggcatccgtacccgggaatcccggggtccctgacccgattcgaggtggcaggcgggtctgggacagatttcactctcacatcagcagcctagcaggctagaagatggtggaccttagtttattntgtacaaactaattattaagttatacttcgtaggtacgttcgggaccaaaggggtaccaaagggtgaattagtacgaaggtaaccgtaacgtggtcgggactacgacctaaccgttattccgtacgtttaccttaccgtaccgttccccgttaccccgacttacgttccgtacggaaccgtaacggtaacgttaacgttaccggtagggaccggggtccgggacgtaccgggaccgtaacgggccgtaagacgtacgtacncgcncgnng

SEQ ID NO: 316220 - DNA, 662 bp, Homo sapiens
  misc_feature: GZ8MTXP02I8CL0.19.21.B10.1.454.CMB.2.raw
  modified_base (323)..(323): a, c, t, g, unknown or other
  misc_feature (323)..(323): n is a, c, g, or t
  modified_base (457)..(457): a, c, t, g, unknown or other
  misc_feature (457)..(457): n is a, c, g, or t
tcagtactctcgtgcacgaccggtgctcgatttagtgtcgtcgcaagagaggaggggggggtacaacaggcaggcagtggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattctttatacagttaccaaacaatagaaaactacttagcttaggtaccagcagagaccaggacacgcctccgtaggctgctacattttacgnggggactacgtccgtaaccccggggaattccccgggggtaccccctaggacccgtaatttccgaggttcggccacggggtccgggttcgtaggggacctagtacttttcaaccttctacaaccctatacgaacncgacgtcgacgaccgaggtacaaggaagtagtggtacgtagtttaagtttattagttaccgtaaactaaattaatttaaatttacttaacgtttacgttacggttacggttaccggtttaccggaaacggtaaacggtaaacgtacgggtaagtaacttacgaacgtaacgtaaccgtaacgtaggtacggtcttacgtaacccg

SEQ ID NO: 316221 - DNA, 657 bp, Homo sapiens
  misc_feature: GZ8MTXP02FYHU5.19.21.B10.1.454.CMB.2.raw
tcagtactctcgtgcacgaccggtgctcgatttagtgtcgtcgcaagagaggaggggggcgagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgacagtgttgcgttggcacgtgggtcaggcacgtcccagtcgagaggtctaggacgtggcgtaggggaagtactattactttcaagttcgtaccgaaacgacggtaggtaaaactaacgtaaaatttacgtacgacctacctacttcgtaggttaggaagtacgtaccgtaacgtagaaactaaacgtaccgaaaacggttacgaaacaactaacgttaacggaaaacgtaaacccgtaacgttcctaccccgttaggacctacgtaccgtcgtaacccttcgttacggtaccgtacccggtaaacccggaacgggtaacccgtacggggttacgttaataagtttaccgtaggtaacgggaacgtaccggaccccctaagtaaccg

SEQ ID NO: 316222 - DNA, 574 bp, Homo sapiens
  misc_feature: GZ8MTXP02JUX3S.19.21.B10.1.454.CMB.2.raw
  modified_base (353)..(353): a, c, t, g, unknown or other
  misc_feature (353)..(353): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctacacctgtcgcctagtccgtccggggacagacgtcgctagcgacagtgttgcttggcacgtgggtcaggcacgtccccagtcgaggtcgtacgagtggtcgtggagggacgatatttctangtcaccacgtagagtacaataatgcaccacgtctgttgtagaagtcgacgtagacaattacaaccgaagtaacaccatacgaacggaaacctaacgttctcccttacggcaacggcgttcgtaacgtcctcgtacgttacgtcccgtaccggacggacggtaccggtacggttaacgttaacttacgttacggtaggaacggacccggacctaacgaaccg

SEQ ID NO: 316223 - DNA, 581 bp, Homo sapiens
  misc_feature: GZ8MTXP02GJYPC.19.21.B10.1.454.CMB.2.raw
  modified_base (435)..(435): a, c, t, g, unknown or other
  misc_feature (435)..(435): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtcgaacgccctcgcacgaccctctcgctccactgtcgccatccgtccggggacagacgtcgctagcgacagtgtcgcgttggcacgtggtcaggcacgtccccatcggagacggttcaggagtcggcgtaggggaaaggtctattactttcattcgtaccaaacgtacggtaggtaaacttaacaaattatcgaccactatctgttagagtagcatagacaatacgaagtanacacgtatacggaaacgtaacctcgttaccctcgagacagtcctacgtcccttgtacgtacgacctaccgggacggtaccgtacggggttacttaacgtaacgttacgagggttacggaaccggtaccgtacccgtagtaacccgg

SEQ ID NO: 316224 - DNA, 569 bp, Homo sapiens
  misc_feature: GZ8MTXP02JB3YU.19.21.B10.1.454.CMB.2.raw
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
  modified_base (453)..(453): a, c, t, g, unknown or other
  misc_feature (453)..(453): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (557)..(557): a, c, t, g, unknown or other
  misc_feature (557)..(557): n is a, c, g, or t
tcagtactctcgtgcacgaccggtgctcgatttagtgtcgtcgcaagatagaggggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccacgatcaactgacaagtccagccaactaattctttaanactagttaccaaacaatagaaaacttctagcttaggaccngacagacgaccgaggacacgtcctcctaggctgcctctagtttacgngggctatccggtaacccggggtatcccggggtcctagacccgtattcgagtggaccagggtccggggtactaggggactagtactttccgactctaccacatcacgcacgcctgaccgagngagaagtagtggtagacgttatttagttattagtacctaataattattaattatacgttacgngtacgtcgacgaggacgtaggngtantacgaagacaagtgngtactgactacg

SEQ ID NO: 316225 - DNA, 621 bp, Homo sapiens
  misc_feature: GZ8MTXP02H0QAU.19.21.B10.1.454.CMB.2.raw
  modified_base (156)..(156): a, c, t, g, unknown or other
  misc_feature (156)..(156): n is a, c, g, or t
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (452)..(452): a, c, t, g, unknown or other
  misc_feature (452)..(452): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccanaaggtgtcctgtcacaagtacagctgcagcagtcaggtccaggactggtgaacgccctgcacgaccctntcgctcacctgtcgcctagtccgtccggggacaggagtcgcgtagcgacnggtgttgcttggcacgtggcaggcacgtcccagtcgagtgtctagagtggcgtaggggaagtactattactttcgagttcgtaccaaacgacggttaggaaaacttaacgtaaaatttatcgaccactatcgtgttagaagtagtacgactagaactaaatacgtaaaaccggtaanaaccaactaacgtaacgaaacgtaacctacgttacccgtaccgtacgacgtacgtcctacgtaccttacgtacgtaccgtacccgtaccggtaacggtaccggttaacggttacttaacgttaacggttacgtacgggtacggaaccggtacccgtacccgtaagtacg

SEQ ID NO: 316226 - DNA, 624 bp, Homo sapiens
  misc_feature: GZ8MTXP02JWML8.19.21.B10.1.454.CMB.2.raw
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagaggagagggggggtacaacaggcaggcaggggcagcaagatggtgttgcagacccaggtcttcatttctctgttgctctggattctctggtgcccacggggacatcgtgatgacccagtctccagactccctggctgtgtctcgtggggcgaggccgggccacgactacgaacgtgacaagtccagccacaatctttaanactatacaanatagaaactactanctagacagcagacgaccgagacacgcctcgagctgctactactttacgnggactacgtaccgtaccgggtacgtcccggtacctacgaccgtatacgacggtcggacgacgggtcgggtcgtagggactagtacttacacctacaccactatacgacgcacgtctagacgacgactagaagtagtggtagtacgttaagtttattagtagtaacctaagttaatttatttattacttacggttacgtacggtaccggtaccggaaaccggtaaacgggtaaccgtaagggttacgtaaacgtaacgtacgaacggtaacgtacggttcggtacggtaccgtacgacctaaccg

SEQ ID NO: 316227 - DNA, 753 bp, Homo sapiens
  misc_feature: GZ8MTXP02FNVFY.19.21.B10.1.454.CMB.2.raw
tcagtactctcgtgcacgaccggtgctcgatttagtgtcgtcgcaagagaggaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccagtccgtcggggacagacgtcgctagcgactagtgtgcgttggcacgtggtcaggcacgtccccagtcgagaggtactaggaggtggcgtaaggggaacgtactaattacgtttacaacgttacgtacccaaacgtaacggttaacggtaaaacttaacctaaaatttacgtacgaacctaacctagttcgtaggtttaggaacgtaggtaacccgtaataacggtaaactaaacttaaccgtaaaacgggttaaacgaaacctaaaccgtaaacgttaaaccgggaaaacccggtaaacccttaacccggtttaccctaccccggttaggaacccgtacgttaccgtaccgggtaacccctttacgttacgggtaacccgtaaaccccggtacccggtaaaacggggtaaccggtaaaccgggggttatttaaaacgttaacggttaaccggttaaggggtaaccggggaaaaccggtaaccccgggtaaccccctaaaggtaaacccg

SEQ ID NO: 316228 - DNA, 631 bp, Homo sapiens
  misc_feature: GZ8MTXP02HUN0O.19.21.B10.1.454.CMB.2.raw
  modified_base (317)..(317): a, c, t, g, unknown or other
  misc_feature (317)..(317): n is a, c, g, or t
tcagtactctcgtgcacgaccggtgctcgatttagtgtcgtcgcaagagaggaggggggcagagtctgctgaattctggctgaccagggcagtcaccagagctccagacaatgtctgtctccttcctcttctcctgcccgtgctgggcctcccacaaggtgtcctgtcacaagtacagctgcagcagtcaggtccaggactggtgaacgccctcgcagaccctctcgctcacctgtcgcctatccgtccggggacagagtcgctagcgacagtgtgcttggcacgtggtcaggcacgtccccatcgagcgtctaagngtggcgtaggggaagactagtatttcacgttgtaccaaactacggtaggaaaacttaacaaaattttaactacgacctaactagttcgtagttagaacgtacgtacgtaactacgaactaaataacgtaaacgtaacgtaacaacgtaacgtaacgtaaacgtaaaccgtaaccgttacctaccgtacgacgtacgtacgtaccgtaccgtacgttacgtacgtaccgtaccggtaacggtaccggtaacggttacggttaacgttaacgttacgtacggtacggtaacggaaccggtaacccgtaacgtaacg

SEQ ID NO: 316229 - DNA, 675 bp, Homo sapiens
  misc_feature: GZ8MTXP02FPXPI.19.21.B10.1.454.CMB.2.raw
  modified_base (328)..(328): a, c, t, g, unknown or other
  misc_feature (328)..(328): n is a, c, g, or t
tcagtactctcgtgcacgaccggtgctcgatttagtgtcgtcgcaagagagagtggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacaggacgtcgctacgcgactgtgttgcttggcacgtggtcaggccacgtccccagtccggagtaggtcgtaaggnggtggccgtaggggaagactattatttcattcgaccaaacgtacggtagaaactaactaaagtatacgcaaccattcgttgttagaagtacggtacgacgttacgaaacaaacgttacgtaaacgtacgaacgtaacgtaacgttaaccggaaaacgtaaacccgtaacgtttccccgtacccgttacggaacctaaccgtcgttaacccgtaaccgtttccgtacgggttacccgtaacccgttaccccggggaacggtaaccggtaacggggtttacgttaaacgttacgtttaaacggtacggttaacgggggtaaaaccggtacccggaacccccgttaaagg

SEQ ID NO: 316230 - DNA, 772 bp, Homo sapiens
  misc_feature: GZ8MTXP02IV4TU.19.21.B10.1.454.CMB.2.raw
  modified_base (251)..(251): a, c, t, g, unknown or other
  misc_feature (251)..(251): n is a, c, g, or t
tcagtactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccaccatcaactgacaacgtccagacccaactaattcttttaanactacgttaccaaactaaataacgtaaaacttacttagtaccttacggtaaccagaccaagaacgaccgaaacggacacgtaccctaccgtacggctagccttactaacgttttaccggtgggtacctaacggttacccggttaaaccccggggtaaaccggttcccccgggggttacccccctacggtaaacccccggttattaccggaacgggtttaccggggccgtacgggggtcccgggggttacggttaacgggggacctaacggttactttccctaaacccttcccgttaacccaaccgtactaccgaacgtccgaacgtcccgtagacgtaacggactaaggaaagtagttggaggttactttaagtttacgtattacgaactaaataatttaatttataacgttcgttacgggtacggtaccggttaccggacggtaaaacggggtacctaagggggtataacttacgtaaccgaaggtaacccggtaagtcggtaacgccggttacgaaccg

SEQ ID NO: 316231 - DNA, 632 bp, Homo sapiens
  misc_feature: GZ8MTXP02GXP6Y.19.21.B10.1.454.CMB.2.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (326)..(326): a, c, t, g, unknown or other
  misc_feature (326)..(326): n is a, c, g, or t
tcagtactctcgtgcacgaccggtgctcgatttagtgtcgtcgcaagagaggaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcgaactgacaagtccagcccanaattcttttaanacataccaaanaatagaaactatagtcttagaccagacaagacgtaccaagacacgtcctacgtaggctgctactattacgnggactagtaccgtaacccgggagtcccgggtcctacgacgtatacgagtcgacgacggcgggtacgtagggactagtattacacttacaccaccactacacgacacgtacgtacgacgacgacgtagaagtaagtaggtaggtacgttaagtttagtttaagttaagtaacgtaaactaaacttaattaatttaattacgttacgttacggtacggtacggtaccggtaaacggtaaacggtaaacggtaacggtaacgtaacgtacgtaacgaacgtaacgtacgtacgtacgtacgtacgtacg

SEQ ID NO: 316232 - DNA, 530 bp, Homo sapiens
  misc_feature: GZ8MTXP02FIRXX.19.21.B10.1.454.CMB.2.raw
  modified_base (231)..(231): a, c, t, g, unknown or other
  misc_feature (231)..(231): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (406)..(406): a, c, t, g, unknown or other
  misc_feature (406)..(406): n is a, c, g, or t
tcagtactctcgtgcacgaccggtgctcgatttagtgtcgtcgcaagagaggaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgtcgccatccgtccgggganagagtcgctagcgacagtgttgcttggcactgggtcaggcagtccccatcgagaggtcagagtggctgggaagcatatttcatcgtccaacacggtgaaactacaaattngcaccagttcaggttnaagtgtcactgaacaatacaaacgtagacacatcgaaagaaccagttcnccctgacacgctcgacctctgtcgaccctacccgaggaaccgacgggtcgtattatacttgaggacgacggaccccataacgacgaatcgaacccgtacctcgtctcgtacgtcgacgttaacg

SEQ ID NO: 316233 - DNA, 646 bp, Homo sapiens
  misc_feature: GZ8MTXP02G9VCG.19.21.B10.1.454.CMB.2.raw
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
  modified_base (403)..(403): a, c, t, g, unknown or other
  misc_feature (403)..(403): n is a, c, g, or t
tcagtactctcgtgcacgaccggtgctcgatttagtgtcgtcgcaaggagagaggggggaggtacaacaggcaggcaggggcagcaagatggtgttgcagacccaggtcttcatttctctgttgctctggatctctggtgcccaggggacatcgtgatgacccagtctccagactccctggctgtgtctctgggcgaagcgggccaccgatcgaactcgacaaaggtccagccacaatctttttanacctagttcccaaacaaattgaaaaaaccttntacgtcttcgtacagcaagacgactaaggactacgcctacgtacgctgacgttactacgtttacgnggtcctacgtaccgtacggtacgtccgggtacccctagaccgtacttcggacgtggccngggtccgttacgagggtactaagttacgttccactcctacaccgtatacgacgacacgtccacgacgttaggactaacggaagtacgtcggttagtaactagttttacgtacgtagtaaacttaaaactatttaattaccggttaacttacggtacggtacggtaacgttcggaacgtaaacggacgttaacggtacgtaacttaagaacgtaacgaaccgtagttcggcgtacgtcgtaacg

SEQ ID NO: 316234 - DNA, 747 bp, Homo sapiens
  misc_feature: GZ8MTXP01D17OR.52.45.E01.1.454.CMB.2.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgccctnagtgtctcggggccccagggcagaggtcaccatcctcctgcacgtgggancagcctaccaacgagtcggggcttaggttttgagttgtatacgtggtaccagcagcgttacccgggaacacgaccccccaaagttccctactaactttcgtttacggtaaacacgtacccaaacggtccggccccgtacccggggtcccctaacggacccgttcgttcctaccgtcggtacctacccgaacgttccgtcggaccctacctccgacgtcccctacccgtcggaccctacttccgacgttcgggcccttacccgaaggtcccgttagggggaacggtacgttacgggaacggtaccgttacggttaatttaacgtttaaccgtcggtaccctaacggtttcccctaaagttccggaacttaaaccgggtccaaacggtccccgttaggggttaaccgtttcgggttttaccgtttttcgggggtaccgtttaacccggggttaaacggtcggggttaaaccccgtaacgggggtttaaccccttaaccccggggg

SEQ ID NO: 316235 - DNA, 666 bp, Homo sapiens
  misc_feature: GZ8MTXP01CA415.52.45.E01.1.454.CMB.2.raw
  modified_base (392)..(392): a, c, t, g, unknown or other
  misc_feature (392)..(392): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggagcagctccaacagtcggggctaggttttgattgtatactggtaccagcagccgttaccgggaacaccgacccccaaactccctactacttctttaggtaaacacgacccgtaacgtccggccccgttcccggggtccctacgacccgtnttcctccgtcggcctccgaacgtcgtcggacccacccgttccgacgtcccctcccgtcggacccctacgttaccgaccgtcgggtccctaccgacgggccgtagggggaggtacgtgggaacgggtccttaggtaactttacgttaaccgtcgtacccgtaacgttccctaagtaacgacgacgccacgtccgtgttacggtttcggtttcggttttggggtccgttaacgggtacgttacggggttacccgtaacgggttcccgtaacccggg

SEQ ID NO: 316236 - DNA, 622 bp, Homo sapiens
  misc_feature: GZ8MTXP01DZ1S5.52.45.E01.1.454.CMB.2.raw
  modified_base (449)..(449): a, c, t, g, unknown or other
  misc_feature (449)..(449): n is a, c, g, or t
  modified_base (530)..(530): a, c, t, g, unknown or other
  misc_feature (530)..(530): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccaggcagaggtcacatctcctgcacgtgggagcagcctaccaacgagtcggggctaggttttgagttgtatacgtggtacccagccaggtccgttaccgggaaacaccgaccccccaaaacttccctatacttcgtttaggaaacacgacccaacgtccggccccgtcccggggtccctaacgacccttgttcctcgtcggcctaccgaagttctacggcctacctcacgtccctcccgnggacccatccgacgtcggcctccgagggcctggggaaggacttgacggctagtatttacgttacctgaccctagttcctanaacgaccgttgacagtcccgtaggttacggtttgtttacggttttgggtccttaaccgggaagtccggggaactaacgggttcctaacccgg

SEQ ID NO: 316237 - DNA, 644 bp, Homo sapiens
  misc_feature: GZ8MTXP01DXIRL.52.45.E01.1.454.CMB.2.raw
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
  modified_base (388)..(388): a, c, t, g, unknown or other
  misc_feature (388)..(388): n is a, c, g, or t
  modified_base (484)..(484): a, c, t, g, unknown or other
  misc_feature (484)..(484): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgactgacgcagccgcctcagtgtcgtcggggccccagggcagagggtcaccatcctcctgcacgtgggancagctaccaacgagtcggggctaggttttgatgtatactggtaccagcagccgttaccgggaaacnccgaccccctaaactcctacattcgtttaggtaacagaccaacgtccggccccgtcccgggggtccctacgaccctnttcctacgtcgggtcctacgaacgtctcggcctacctcacgtccctcccgtggaccctactccgacgtcgggacctccgaggtccgtggggaggtnttgggaacgtcgtagtactttacgttaacgtcgtacctagttaccctagtaacgacttacgcgttacgtccgtggttacggtttcggtttaccggtttttgggtaccgtttaacgggtaaccgttcgggggaacccttaacgggttcccgtaaccccggg

SEQ ID NO: 316238 - DNA, 706 bp, Homo sapiens
  misc_feature: GZ8MTXP01BWOTO.52.45.E01.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (596)..(596): a, c, t, g, unknown or other
  misc_feature (596)..(596): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctcgggcccagtctgtgctgacgcacgcccgcctgagtcgtccgtcggggccccgagggcaggacggtccacctntcctctgctacgtgggacncagctaccaacgngtcgggcttaggtttnagtgtaatacgtggtaaccagcacgtccgtaccggaaacnccgaccccctaaactcctactattcgttaggaacacgaccctaaccgtccggtccccgtcccggggtccctaacggtaccctgttcctccgtcggtaccctaccgtagtcgtccgacctaccgtccaccgtccctacccgtcggaccctactaccgtaccggtcggcctaccgaggtccgttagggggaacggtagtcggacggttataggttaactttacgttaaccgtcggtacccttaacggttcctaagtcgaaacgttcggtaaccnggtaccccggtaggtttaccggtttcgggttttaccggttttcgggggtaccgttaacccgggtacggttaccgggttaaacccgtaacgggttccccgttaaccccggg

SEQ ID NO: 316239 - DNA, 679 bp, Homo sapiens
  misc_feature: GZ8MTXP01BZ3T2.52.45.E01.1.454.CMB.2.raw
  modified_base (192)..(192): a, c, t, g, unknown or other
  misc_feature (192)..(192): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgcctnagtcgtcgtcggggccccagggcaggagggtcaccatctcctgcacgtgggacgcagctaccaacgacgtcggggctaggtttagattgtatacgtcggtaccagcacgtccgttaccgggaactaccgaccccctaaacgtccctactacttacgtttacggtaaacacgtacccctaacggtccgggtcccccggttcccgggggtcccctaacgggtaccccggttaactttcccgtccgttcgggcccttacccgtaacggttccgtacggccctaccctcgacccggtccctcccgtcggccctactccacgtcggcctaccgacgtcgtaggggacggagtcggacgtctagtacttacttacgtcgtacgtacgttcctagcgaacgttcgcgacgtccgttaggttcggttcgtttaccggttttgggtccgtttaacgggacggtacgggttaacctaacgggttcccgtaacccggg

SEQ ID NO: 316240 - DNA, 673 bp, Homo sapiens
  misc_feature: GZ8MTXP01BO6FQ.52.45.E01.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtccgtcggggccccagggcaggaggtcaccatctcctgcacgtgggacncagcctacagcggtcggcttaggttnagtagtatcgtcgacngcagtccgtaccggaacnccgacccctaactctactacttcgttacggacacgtaccaccggtccggacccggttcccgggtccctaacgtaccgtctttccgtaccgtcggtacctaccgtacggtccgtacgtaccctaccgtaccgccgtcccctcccgtacggaccctacgttcccgcggtccgggacctccggacggtccgtaggggaacggtagtcggtaacggtcttaagttaacgtttacttaccgtcgtacccgttacgttactagaacgaacgccgacgttaccgtcgttaggttcggtttcggttttcggtttccgggtaccgttaacgggtaacggtaccggggttaacctccggggttaaccctaacccggg

SEQ ID NO: 316241 - DNA, 598 bp, Homo sapiens
  misc_feature: GZ8MTXP01EV5J8.52.45.E01.1.454.CMB.2.raw
  modified_base (246)..(246): a, c, t, g, unknown or other
  misc_feature (246)..(246): n is a, c, g, or t
  modified_base (387)..(387): a, c, t, g, unknown or other
  misc_feature (387)..(387): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggcccccagggcaggaggtcaccatctcctgcacgtgggancagcctaccaacgagtcggggctaggtttgatgtatacgtggtaccagcagtccgttaccgggaacaccgacccccaaactcctatattcgttaggaacacgacccaacgtccggacccgtcccgggtccctagacccgtnttcctcgtcggtcctaccgtacgtctcggaccacctcaccgtccctcccgtggacccatccacgtcggcctccgagcctaggggaggtctaggacgctgtaatttacgtactcgacctagtacctancgaacngacttacgcgttggttagtttcggtttcgtttaacgggcttaaccggaacggtcggacctaaggttcccgtaacccgg

SEQ ID NO: 316242 - DNA, 695 bp, Homo sapiens
  misc_feature: GZ8MTXP01DI255.52.45.E01.1.454.CMB.2.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcacatctctgcacgtgggancagctaccaacagtcggggctaggtttnatgtatactggtaccagcagccgttaccgggaaacaccgaccccctaaacttcctactatttcgtttaacggaacacgacccctaacgtccgggtccccgttcccgggggtcccctaaggtacccgtnttcctcgtcggacctccgaagtctacgcctacctaccncgtcccctcccgtggacccctagtccgtaccgtcgggacctaccggaaggtccgttagggggaacgggtagtacggtacgggtaccttaggtaacttttaacgttaccgtaccggtcccttaacggttcccttaagtaacggacgttaaggaccgttaacggtccgttaggttcgtttcggttttccggtttttccggggtacgtttaaccgggtaacgtaccggggttaaccgttaaccgggttcccgttaaccccggg

SEQ ID NO: 316243 - DNA, 719 bp, Homo sapiens
  misc_feature: GZ8MTXP01EA3QQ.52.45.E01.1.454.CMB.2.raw
  modified_base (193)..(193): a, c, t, g, unknown or other
  misc_feature (193)..(193): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctnagtgtcgtcggggccccagggcaggaggtcacatctcctgcacgtgggancagctaccaacgngtcgggcttaggtttgagtgtatacgtggtaaccagcacgtccgttaacccgggaacaccgaccccctaaacttccgtactacgtttactttaacgggaaaccacgtaccccgtaacgtcccggggtacccccgttccccgggggttccctaaacgggtaaccccgttcgtttcccgttccgttaccgggtccccttaacccgttaacgggttccttaccgggaccctacccttacccgaccgtccccgttcccgtacggtcccctaacgttccgaacggttccgggaccttacccgagggttccgtacggggaaaggtcgttcggaaggtcttaggtactttaacttaccgtcgtaccgtattacccgtataacaacgacgccgttgtaccgtggttcgtttcgtttgggtttcgttacggttaacggaacgtcgggaaccgtaaccggttccgttaacccg

SEQ ID NO: 316244 - DNA, 714 bp, Homo sapiens
  misc_feature: GZ8MTXP01CQN4Q.52.45.E01.1.454.CMB.2.raw
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtccgtcggggccccagggcaggacgggtcaccatctcctgcacgtgggancagctaccaacagtcggggctaggtttnagttgtactacgtggtaccagcacggtccgttacccgggaacacccggaccccctaaactcctactacgttcgtttaacggaacacgacccctaacggtccgggtcccgttacccggggtccctacggacccgtcttccgtcgtcggtcctaccgtaacgttcgtacggccctacctccaccggtcccttcccgtcggaccctacgtcccgacggtcgggccctacggacgggtcctaggggacgggtacgttcgggaacgggtccttaggtaactttacgttaccgtcgtacccgtaacggttccctaagtaacggaacacggtaccgaacgtcccggttggttacggttttcggtttccggtttttcgggggaccgtttaacccggggtaacgggtttacggggaaacccttaacggggttccccgtaaccccggg

SEQ ID NO: 316245 - DNA, 735 bp, Homo sapiens
  misc_feature: GZ8MTXP01A9082.52.45.E01.1.454.CMB.2.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (639)..(639): a, c, t, g, unknown or other
  misc_feature (639)..(639): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcagaggtcacatctcctgcactgggancagctcaacngtcgggctaggtttgattgtatactggtaccagccgagtccgttaccgggaaccacggaacccccctaaacttcccgtactagttaccgtttacggtaaaccacgtaccccgtaacggtcccgggtaccccgtcccgggggtcccctaacggtaacccgtaacgtttcccgtaccggttcgggtacccctaaccgtaaacggttcgttaccgggaccctaacccgtccgtaacccgggtccccttcccggtaccggtaccctactttcccgaaccgttcggggcccttacccggaaggtcccgtggggaacgggtacgttacggggacgttaccgtaggttaactttagttaacccgttcgaccgtacgtcccgttaagccgtaacgngtccgacgtcccggtggttacgtttccggtttacgggttttcgggacttccggggtaaacggcgggttaaccgtaacggttcccgttaaccccggg

SEQ ID NO: 316246 - DNA, 661 bp, Homo sapiens
  misc_feature: GZ8MTXP01CO901.52.45.E01.1.454.CMB.2.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccagggcaggacggtcacatctcctgcacgtgggancagctacaacngtcgggtctaggtttgatgtatacgtaggtaccagcacgccgttaccgggaacaccgaccccctaaacgttcctactacttcgttacggtaacacgaccctaacggtccggcccgttcccggggtccctacgacccgtcttcctcgtcgcctaccgaacgtcgtcgacctaccgtcgaccgtcccgtacccgtcggaccctacgtccgacggttcgggaccctccggaaggtccgtaggggacggtacgtcgggacggtctacggttaactttacgttacgtcggtacctagttacctagtaacgacgttacggccgttacgtccgttggttacgtttcggtttcggttttcgggaccgtttaacgggaacggttcgggttaaccgtaacggttccgtaaccgg

SEQ ID NO: 316247 - DNA, 672 bp, Homo sapiens
  misc_feature: GZ8MTXP01DTJ4S.52.45.E01.1.454.CMB.2.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (402)..(402): a, c, t, g, unknown or other
  misc_feature (402)..(402): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcagaggtcaccatctcctgcacgtgggancagctacaacgngtcgggctaggttttnatgtactacgtggtaaccagctacgccgttaccgggaaaccaccgaccccctaaacttccgtactagtttccgtttaggaaacacgtacccaacgttccggccccgttcccggggtccctaacggaacctnttccgtccgtcggtacctaccgtaaggtctcggaccctaccgtcaccgtccctccgtcgaccctagtccgacgtcggcctacgaggtctaggggaacggtgtacgaacggtcttagttaactttacgttaaccgtcgtacccgttaacgttcccgttaagtaacggaacacggtccgttaacgtccgttaggttacggtttcgtttcggttttcgggtacttaaccgggtaacgtaccggggttaccttaacgggttcccgtaaccccgg

SEQ ID NO: 316248 - DNA, 668 bp, Homo sapiens
  misc_feature: GZ8MTXP01EF91X.52.45.E01.1.454.CMB.2.raw
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (390)..(390): a, c, t, g, unknown or other
  misc_feature (390)..(390): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtcgtcgtcggggccccagggcagacggtcacatctcctgcacgtgggancagctacaacgagtcggggctaggtttnatgtatacgtggtaccngcagtccgtaccggaacaccgacccccaaacttcctacattccttaggaaacctacgaccaacgtccggaccccgtccggggtccctaaggaaccccgttnttccgtcgtcgtacctaccgacgtcgtaccgcctaccgtacgaccgtccctcccggtacgtaccctacgtaccgaccgtccggtaccctacggacggttacgtagggggtaacgtacggtaacggacggttacttagttaactttacgttacgtccgtacctacgtacgtagtaacgacttcggtacgcgtaccggttagttcggtttcgtttcgggtttaacgggttacgtaaccgggtacggtaccgggttaaccgttaacggttccccgtaaccg

SEQ ID NO: 316249 - DNA, 636 bp, Homo sapiens
  misc_feature: GZ8MTXP01EUD25.52.45.E01.1.454.CMB.2.raw
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctggcccagtctgtgctgacgcacgcccgcctcagtcggtccgtcggggccccagggcaggacggtcacatcctccgtgcgacgtgggancacgcctaccaacgaggtccgggtattaggtttnacgttgtatacgtgaccagccgagtccgtacggaaacctaccgaccccctaaacttcctactactttcgttacggaaacacgtaccccaacggtccggccccgtccgggtaccctaggacctcgttccacggtcgacctacgtagtctcgacctacctcaccgtcctccgtcgacctactacgtacgtcggccgtccgacgtacgtacggggaggtagtagtacggtcgtagtaacgttacttacgtacgtaccgtaccgtcctacgtaagacacgacgacgtccgtagttcgttcgtttcgtttcggttcgttaacggtacggtacggaccgtaacgttaaccgtaaccg

SEQ ID NO: 316250 - DNA, 718 bp, Homo sapiens
  misc_feature: GZ8MTXP01COMAX.52.45.E01.1.454.CMB.2.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
  modified_base (421)..(421): a, c, t, g, unknown or other
  misc_feature (421)..(421): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcccctgggcccagtctgtgctgacgcagcccgcctcagtgtcgtcggggccccagggcaggacgggtccaccgatcctcctgctacgtgggancacgcctaccgaacngtcgggtcttaggtttgattgtaatacgtggtaccagcctacggtccgttacccggaaacncccgaccccctaaacttccctacgtactttacgttaggtaacacgtaccctaacggtccggaccccgttcccggggtccctaacggacccgtnttcccgtacgtccgggtaccctaccgtaacggtttccaccggaccctaacccgtccaacccggtccctacccgtcggtaccctaccgtaccgtaccggttacgggcccttaccgacgggttccgagggggaacggtaggtacggtacgggtaccttagttacttacgttaaccgcgtaccgtacgttaccttagaaccgtaacgacgcgaagtcccgtagttacgttcggttttaccggtttggggtaccgttaacgggtaacgggtaccggaccgtaaccggttcccgtaacccgg

SEQ ID NO: 316251 - DNA, 682 bp, Homo sapiens
  misc_feature: GZ8MTXP01BZGH3.52.45.E01.1.454.CMB.2.raw
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtcgtccgtcggggcccccagggcaggtacggtcacctagtcctccgtgccacggtgggacncacgtctaccgaagtagtcggggcttaggtttcagttgtatacgtgtaccngcagtacgtccggaacnccgtacccctaactctacattcgttagaacncgccaacgtccggtcccgtccgggtcctaacgtaccgtgttccgtcgtcgtacctccgtaagtccgtcggaccctaccacgcgtccctaccgtcggaccctctaccgtacgtcgggtcctaccgaggtccttagggggaacggtgttacgggtacgtacgttacgttacgttaccgttacgtactaccgttacgttaccgacgtaacgaacgttcggacgttcgttaccgttgggttcggtttcggttttaccgggtttaacgggtaccggttaacggggttaaccgggtccgggttaacccgttaaccgggttcccgtaacccgg

SEQ ID NO: 316252 - DNA, 513 bp, Homo sapiens
  misc_feature: GZ8MTXP02FWNO9.52.45.E01.1.454.CMB.2.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
tcagcgcagtacgacacgaccggtgctcgatttagtgagtcagtaagggaaaggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctgggccccagggcagagggtcaccatctcctgcactgggagcagctccaacatcggggcaggtttgatgtatactggtaccagcagcttccgggaacacgcccccaaactcctcatcttggtaaacngccaatccggccctccggggtccctcgacccgnttcctctggcctccaagtctcggcacctcacgcctccctgccatcacgtgggctccaggctggagatgaggctagattatactgcctagtcctaatcgacagcacgcctgacgtgttacgtttggctttcggaacgtgggacctaaggtctacccg

SEQ ID NO: 316253 - DNA, 517 bp, Homo sapiens
  misc_feature: GZ8MTXP02IPWPD.52.45.E01.1.454.CMB.2.raw
  modified_base (240)..(240): a, c, t, g, unknown or other
  misc_feature (240)..(240): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagcgcagtacgacacgaccggtgctcgatttagtgagtcagtaagggaaaggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagaggtcaccatctcctgcactgggancagctccaacagtcggggcaggttttgatgtatactggtaccagcagcttaccggaacacgcccccaaactcctcacttctttaggaaacagcccaacgtccggcccctccggggtccctgaccgntttcnctcggctccaagtctggcacctcacgcctcctgccatccacgtgggcctccgaggctgaggtatgaggctgattatctgtccagtcctatcgacagcagcctgcgttgttcgtttaaggcttacggactggacctaggtctacccg

SEQ ID NO: 316254 - DNA, 536 bp, Homo sapiens
  misc_feature: GZ8MTXP02FGX0Z.52.45.E01.1.454.CMB.2.raw
  modified_base (356)..(356): a, c, t, g, unknown or other
  misc_feature (356)..(356): n is a, c, g, or t
tcagcgcagtacgacacgaccggtgctcgatttagtgagtcagtaagggaaaggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtttgatgtatactggtaccagcagcttccggaacacgcccccaaactcctcatcttggtaaacagccaatcggccctccggggtccctgaccgtntctctggcctccaaagtctaggccaccgttccacgccctccctggccatcacgtcgggacctccgaggctaggacggatggagggctaggaatttagttactggacctagttccctaatcggacagcagcctgagtgttctttgggtcttacggaacgtgggaaccaaggtctaacccgg

SEQ ID NO: 316255 - DNA, 596 bp, Homo sapiens
  misc_feature: GZ8MTXP02IHK27.52.45.E01.1.454.CMB.2.raw
  modified_base (239)..(239): a, c, t, g, unknown or other
  misc_feature (239)..(239): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagaggtcaccatctcctgcactgggancagctccaacagtcggggctaggttttgatgtatactggtaccagcagccttaccgggaacacgcccccaaatcctcatctttaggaacngccaatccggccctccggggtaccctgacccgtnttcctctcggcctaccgaagtcctggccctacgtccacgccctcccgtgcccactcacgtcgggcctcgagggcctaggacggtatcggagggtctagatttacgttactgcctagtaccctagtacggacaggcaaacggcccttaggtacggtttcgtttaccggtttttgggggtaccctttacggggaaaacgttcggggaacccttaaaggggttccctaaacccggg

SEQ ID NO: 316256 - DNA, 586 bp, Homo sapiens
  misc_feature: GZ8MTXP02GYD9O.52.45.E01.1.454.CMB.2.raw
  modified_base (249)..(249): a, c, t, g, unknown or other
  misc_feature (249)..(249): n is a, c, g, or t
  modified_base (387)..(387): a, c, t, g, unknown or other
  misc_feature (387)..(387): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctgggcccagtctgtgctgacgcagcccgccctcagtgtccgtcggggccccagggcaggagggtcaccatcctcctgcacgtgggancagcctaccaacagtcggggctaggtttgatgtatactggtaccagcagtcgttaccggaacaccgacccccaaaactcctacattcgttaggtaaacacgacctaacgtccggacccgtccggggtcctgacccgtnttctctcggcctaccgaagtcctggccaccgtcacgccctcctacgccactcacgtcggctcgagctgagtgtgacgctagtattaacgtacgtcgacctacgtcctaagtacgaacacgcgacgtcccgtagtacgttcgtttccgttgggtccgttacgggtaacgtcgggtaaacctaacggttccgtaaccccgg

SEQ ID NO: 316257 - DNA, 599 bp, Homo sapiens
  misc_feature: GZ8MTXP02H9UPA.52.45.E01.1.454.CMB.2.raw
  modified_base (244)..(244): a, c, t, g, unknown or other
  misc_feature (244)..(244): n is a, c, g, or t
  modified_base (440)..(440): a, c, t, g, unknown or other
  misc_feature (440)..(440): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctctgcacgtgggancagctccaacgagtcggggctaggtttgatgtatacgtggtaccagcagccgttaccgggaacacgaccccccaaatccctacacttctttaggtaaacagtacccaaacgtcccggaccccgtccggggtcccctaggacccgtcttcctcgtcggtccttaccgaagtctcggccctacctcacgccctcccgngccatcacgtcgggctccgaggctgaggtactggaggtctagtattactacgtcgacctagttcctaatgaaccgagacacgtcgtagtcgtttcggttacgttttcggggtaccttacgggaacgttacgggaacccgttaacgggtaccctaaccgg

SEQ ID NO: 316258 - DNA, 554 bp, Homo sapiens
  misc_feature: GZ8MTXP02JPGJY.52.45.E01.1.454.CMB.2.raw
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcacgtgggagcacgctccaacagtcgggctaggtttgatgtatacgtgtaccagcagtcgtaccggaacacgaccccctaaactcctacattctttagaacagacctaacgtccggccctaccggggtccctcgaccgtnttccgtctcggacctccgtaagtctacggccacctcacgccctcctcgcctactccacgtcgggactccgagcctggacgntgacgggctagtacttatacgtcgacctagtccatcgacagcacgcctagacgttcgttcgttcggtcttaccggacgttcggacgtacgtacgtacccg

SEQ ID NO: 316259 - DNA, 600 bp, Homo sapiens
  misc_feature: GZ8MTXP02JQ48D.52.45.E01.1.454.CMB.2.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (347)..(347): a, c, t, g, unknown or other
  misc_feature (347)..(347): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggagggtcaccatcctcctgcacgtgggancagcctccaacngtcggggctaggtttnatgtatacgtggtaccagcagccgttaccggaacaccgaccccctaaactcctactacttcgtttagaaacngacccacgtcccggccccgtccggggtccctggaccctcttcctcgtcggtcctacgaacgtctcggccacctccacgtccctcccgtcgacccacgtccaccgtcgggaccctccgaggtcctagggacggtagtcggacggtctagtacttacgtactcgacctacgtcctagtacgactagccagtccgtagtcgttcgttcgtttcggtacttacgggtaacgtcggtaaccgtacggtccgtaaccgg

SEQ ID NO: 316260 - DNA, 608 bp, Homo sapiens
  misc_feature: GZ8MTXP02JDTBX.52.45.E01.1.454.CMB.2.raw
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtggggccccagggcaggagggtcaccatctcctgcacgtgggagcagctccaacagtcggggctaggttttgatgtatactggtaccagcagcttaccggaacacgaccccaaactcctcactctttagaacngccaatccggccctccggggtccctcgaccctnttcctcgtcggcctaccgaacgtctcggcctacctcacgtccctcctgacctntccacgtgggcctccgaggcctaggacggtatggacggtctaggtactttataccgtcggaccctaggtccctaagtcggaccacggccaacggtcccgttaggtacgttcgtttaccggtttttggggtcccgtttacggggaaaaccgtttcgggggaaaccctaacgggttcccgtaaacccggg

SEQ ID NO: 316261 - DNA, 704 bp, Homo sapiens
  misc_feature: GZ8MTXP02FWN5O.52.45.E01.1.454.CMB.2.raw
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagaggtcaccatctcctgcacgtggagcagctaccaacagtcggggctaggtttgatgtatacgtggtaccagcagccgttaccggaacaccgacccccaaaactccctactacttcctttaggtaaaccacgtacccaacgtcccgggaccccgttcccggggtccctacgaccgtacttccgtcgtcggacccttccgaaacgtcgtacggcctacccgttccacgtccctcccgtggacccactccgaccgttcgggacccttccggaacgggtccgtacgggaagggtacgttacgggacgggtaccttaggttaactttacgttaaccgtcggtaccctaacgttaccctttaagtacgacgaacggtccgaacggtcccttgggttaaccgtttcggttttaccggttttcggggttacccgtttaccggggtaaaccggttacggggaaacccgtaacggggttaccccttaaacccccgggg

SEQ ID NO: 316262 - DNA, 638 bp, Homo sapiens
  misc_feature: GZ8MTXP02GNIMQ.52.45.E01.1.454.CMB.2.raw
  modified_base (242)..(242): a, c, t, g, unknown or other
  misc_feature (242)..(242): n is a, c, g, or t
  modified_base (521)..(521): a, c, t, g, unknown or other
  misc_feature (521)..(521): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcgggccccagggcaggaggtcaccatctcctgcactgggancagctccaacatcggggctaggtttgatgtatacgtggtaccagcagcttacccgggaaacacgaccccctaaaacgtcctctacttcgtttaggaaacagaccaaacgtcccggccccgtacccggggtccctagacccgtacttccgtcgtcggtaccttaccgaaagttccctagggacccaacccttccgaacgtcccctcccgtcggaccctagttccacgttcgggcctacgacggtctaggaaggatggacggacttagactttacgttacncggtcccaagttcccttaagtccggaaacacgccgtacgtccgttgtacgtttcgtttacggttttaacgggtaccgttaacgggtaacgtacgggaaccgtacggtaccgtacccg

SEQ ID NO: 316263 - DNA, 674 bp, Homo sapiens
  misc_feature: GZ8MTXP02IW8IG.52.45.E01.1.454.CMB.2.raw
  modified_base (287)..(287): a, c, t, g, unknown or other
  misc_feature (287)..(287): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcacgccgcctcagtgtcgtcggggccccagggcaggaggtcacatctcctgcacgtgggagcagcctacaacagtcggggctaggttgatgtatacgtggtaccngcagtcctaccggacaccgacccctaaactcccgtactaacttcgtttaggaaacacggtaccctaaacgttccccggggccccttacccgggggttccccttcggaacccgttctttccgtcgttccgggtacccttaccgaaagttccgtcggtaccctacccgttccacccgtcccttcccgttcggaccctacgttccgacgttccgggacctcccgaaggtccgtggaagtcgttagggagtacttcgtaacttagttactcgaccgtacgtctacgtcgacgagaccgacgttccgtgttacggttcggtttaacggttttcggggtacctttaaccgggtaacggttaccggtaaaccgtacgggttaccgtaacccggg

SEQ ID NO: 316264 - DNA, 775 bp, Homo sapiens
  misc_feature: GZ8MTXP02GJBEX.52.45.E01.1.454.CMB.2.raw
  modified_base (247)..(247): a, c, t, g, unknown or other
  misc_feature (247)..(247): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtccgtcggggccccagggcaggagggtcaccatcctcctgcacgtgggancagctccaacagtcggggctaggtttgatgtatacgtggtacagcagccgttaccgggaacaccgacccccaaaactcccgtactacttcgtttacggaaaccagacccctaaacgtccccggtacccgttaccccgggggtcccctacggaacccgtcgtttcctccggttcgggtcccttacccgaaacggttcccttacgggaccctacccgtaccgaccgtcccccgtcccgtaccgggtacccctacgtacccgtaaccggttcccgggggaccttaccccgggacgggtacccgttaggggaacgggtaacgtcgggtaaacgggttccgttaaggttaacttttaaacgtttaaccggttcgtaccccgtaaagtttcccgtaaacgttacgaacccgtaggacctacggtaacccgttgggttaacggtttcggtttaccggttttaacggggttaccgtttaccggggtaaacggttaccggggtaaaccgtaacggggtttacccgttaaaccccggg

SEQ ID NO: 316265 - DNA, 637 bp, Homo sapiens
  misc_feature: GZ8MTXP02GBL5A.52.45.E01.1.454.CMB.2.raw
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
tcagcgcagtacgacacgaccggtgctcgatttagtgagtcagtaagggaaagggagaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggacggtcaccatcctcctgcacgtgggancagctccaacgngtcggggctaggtttgatgtatacgtggtaccagcgaggtccgttaccgggaacaccgaccccctaaacgtcctactattccgttacggtaacacgacctaacgtcccggtacccccgttcccggggtccctacgtaccgtacttcctcgtcggcctaccgaacgtcctcgacctaccctcgaccgtccctcccgtcggaccctacgtccgacgtccgggtcctaccggacggtccgtgggtaaggacgtaggtacggtcttaggttactttacgttacgcgtacctacgttacctagtacgacgtacgacgtcggtccgttaggtcgtttcggttcgtttcggtacgtacggtacggtacggtaccgtacggtacccg

SEQ ID NO: 316266 - DNA, 791 bp, Homo sapiens
  misc_feature: GZ8MTXP02GCSW7.52.45.E01.1.454.CMB.2.raw
  modified_base (176)..(176): a, c, t, g, unknown or other
  misc_feature (176)..(176): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtnctgacgcagccgcctcagtgtcgtcggggccccagggcaggagggtcaaccagtcctcctgcacgtgggacgcagcctaccaacagtcgggctaggtttgatgtatactggtaccngcagcttaccggaacncgaccccaaactcctactattcgttaggtaaaccacgccgaaacgtccggccccgttacccggggttcccctacggaacccgttacgtttcctccgtacgggtacccttacccgtaaaacggtttcccgtcgggtaccctaacccgtttcccggaacgcccccctttaccccgttccggggaccccctaaacgtttcccccgaaaccggttccggggacccttcccgaacggggttcccgttaggaaccgggtaagttcgggacgggtacgtacggttaactttaacgttaaccgttcgtaccccgaacggtttaccctaaacgttcgggtaaccctaaacggcccgtaaaccgggtacccgttccgggtaagtttcggtttaacccggtttttaacgggggtttccccgttaacgggggttaaaaccccgttacgggggtaaaacccggtaaaaccggggttccccgtttaaacccccgggg

SEQ ID NO: 316267 - DNA, 693 bp, Homo sapiens
  misc_feature: GZ8MTXP02ICSO3.52.45.E01.1.454.CMB.2.raw
  modified_base (335)..(335): a, c, t, g, unknown or other
  misc_feature (335)..(335): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtcgtcgtcggggccccgagggcaggacgggtccaccgatctcctgcacgtgggagcagcctaccacagtcgggctaggtttgatgtatacgtgtaccgagcacgccgttaccggaacaccgaccccctaaactcccttacncttacgtttagaacacgaccacgtccgaccgtccggtcctcgaccgtcttaccgtcgtacgtccgtaccgtacgtccgttcggacccacccgtacgtaccgccccttcccggtaccggttaccaaccgtttcccgaccggttcgggtcccggtacccgtaacgggtcctaggggtaaccggtaggtttacggacggtaccggtttaagtactttaacgtttaccgtcggttaccacggttacccgttaattcggaacgttacacgttcgtaccggttacgttaacggtttcttaacggtttcggggtttcgtacccgggtaacgttaccgggtacccgtacgggttaccctacccggg

SEQ ID NO: 316268 - DNA, 732 bp, Homo sapiens
  misc_feature: GZ8MTXP02HKV8S.52.45.E01.1.454.CMB.2.raw
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtcgtcgtcgggcccaggcaggacggtcacatctctgcacgtgggacgcagcctaccaacgacgtcggggactaggtttgatgtactacgttggaccagcagcgttaccggacaccgacccctaaactcctactactttacgtttagaaaccagtacccctaacggttcccggtacccccgttccccgggggttacccctaccggtaaccgttacgtttcccttacggttccggtaccccttacccggtaaacgttcccgggttaaccggcccctaaccctttacccgacccgtccccgttacccccgttcccgggtaccctaaccgttacccgtacccggttaccgggttcccgtacccgtaaccggccggttacgggacggtaggtacgggtacggtcgttacgttaagttacttaccgtacgtaccgtacgtaccgtattacgtacgacgacgtacgtaccgtcgtagttcggtttacggtttcggttcggttaccggtacggtacggtaccggtaaccggtaccgttaaccccgg

SEQ ID NO: 316269 - DNA, 662 bp, Homo sapiens
  misc_feature: GZ8MTXP02IV5VN.52.45.E01.1.454.CMB.2.raw
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (392)..(392): a, c, t, g, unknown or other
  misc_feature (392)..(392): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtccaccatctcctgcacgtgggancagctccaacagtcggggctaggttttgatgtatacgtggtaccagcagccttaccggaacacgacccccaaaactcctactacttcgtttaggtaaacngacccaaccgtccggcccccgtcccggggtcccctcggaacccgtnttccgtcgtcggacccttaccgtaacggtcgttacggcccacccgttcgacgtcccgtcccgtcgcctacgtcacgtcgggcctccgaaggcctagggacggtacgttacggacggtccgttacgtaacgtttattaccgtcgtacccgtaactaccttacgtacggacgaacgccgtacgcccgttaggtaacgttcgttttcggttttaacgggttccttaacggggtaaaccgtgggtaaaccctaaacggttcccgtaaccccggg

SEQ ID NO: 316270 - DNA, 820 bp, Homo sapiens
  misc_feature: GZ8MTXP02IROCP.52.45.E01.1.454.CMB.2.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctgggcccagtctgtgctgacgcacgcccgcctnagtgtccgtccggggccccagggccaggacgggtccaccgattccctcctgccgacgtggggancacgcctaccgaacgaggtcggggacttaggtttgagttgtacgtacgtggtaaccngtcgagtacccgttaccgggaaccaaccgacccccctaaaaccgttccctaacgtacgttttaccgtttaacggtaaaccgacgtaccccgtaaacccggttcccccggggtaccccccggtttaccccgggggttacccccttaccgggtaaaccccgtttcgttttccccgtaaccggttccggggttaccccttacccgtaacggtttcccgttacgggacccctacccttcccgtacccgtcccccgttcccgttcggacccctacgttccgtacccgggtcgggtcccacccggtaaggccgttagggaacgggttacgtacgggtaacggttccgtagtttaaaccgtttaacgtttccgtaacgtcccgttacgttacctacggtacggaacctacggcctaacgggtccttaggttacgtttcggttttacgtttcggggtacccgttacggggtaccgtaacggggtacccgtaacgggttacccgtaacccggg

SEQ ID NO: 316271 - DNA, 674 bp, Homo sapiens
  misc_feature: GZ8MTXP02HNYOE.52.45.E01.1.454.CMB.2.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (593)..(593): a, c, t, g, unknown or other
  misc_feature (593)..(593): n is a, c, g, or t
tcagcgcagtacgacacgaccggtgctcgatttagtgagtcagtaagggaaagggggaggctctgcttcagctgtgggcacaagaggcagcactcaggacaatctccagcatggcctgtctcctctcctcctcactctcctcgctcactgcacgagggtcctggcccagtctgtgctgacgcagcccgcctnagtgtcgtcggggccccagggcaggacggtccacattcctcgtgcacgtgggancacgcctaccgaaacgtggtccggggtacttaagggtttnaagttgtactacgtggtaaccagacgtacggtccgttaaccggaaccaccgaccccctaaaacgttccctatacgtttacgtttacggaacacgaccctaacgtccccggtccgttcccggggtaccctagacccgttcttccgtcgtacgtcctacccgtagtccttcggccttaccctccgctccctcccgtcgtccctactacgtacgtccgggaccaccgacgtcggttacgaacggtgtaggacgggtaccttagtaactttactaccggttcgtaccttacgtaaccttacagaccggtanaaccgtcggtacctggttacgttacggttttcggttaacggtcgttacggtacccgagggtaacctcggttacctacccgg

SEQ ID NO: 316272 - DNA, 631 bp, Homo sapiens
  misc_feature: GZ8MTXP02HO2QM.52.45.E01.1.454.CMB.2.raw
  modified_base (193)..(193): a, c, t, g, unknown or other
  misc_feature (193)..(193): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcacgccgcctnagtcgtcgtcgggcccagggcaggacggtcacatctctgcacgtgggancacgcacgaacgtcggtcgggtnttaggttnagtacgtaagtacgtcgacacgtcgtacgtaccgtaccggaaccacccgtaacccctaactctactacgttacgttacgacacgtacctaccgtccgtcccgtccggtcctacgtaccgtcttccgtcgtacgtcctacgtacgtccacgtcctaccgtccgaccgtcccgtccgtcgtacctacgtccgacgtcgtaccgtcggacgtcgtaggacggtagtacggtacgtactacgttaacttacgtacgtcgtacctacgtactagtacgacgcgtaccgtcgtacgtagttcgtttcggtttacggttcggtacgtaacggtacgtaaccggaccgttaccggtaccgtaccgg

SEQ ID NO: 316273 - DNA, 699 bp, Homo sapiens
  misc_feature: GZ8MTXP02GOCDU.52.45.E01.1.454.CMB.2.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctgggcccagtctgtgctgacgcacgcccgccctnagtcgtccgtcggggccccagggcaggacggtccacatctcctgcacgtgggancagcaccaangtcggggctaggtttnagtgtatacgtggtacagcacgtccgttaccgggaacaccggaccccctaaactcctactacttcgtttagaacacgacccgtaacgtcccggtacccgttcccggggtaccctcggtaacccgtcgttccgtcgtaccggtcccttaccgtaacgttccgtacggaccctacccgttccgacccgtcccgtcccgtacggccctaacgtccgtaaccggtcgggtaccctaccggacggtcgttaccggaagggtacgtcggacgggttacgttaacgttacgtttacgttaccgtcgtaccgtacggttacctagtacgacgacgtaccgtaggccgttaggttacgttcggttttccggtttcgggttacgttaacgggtaacggtaccggtaaaccgtaccggttaccgttaacccggg

SEQ ID NO: 316274 - DNA, 604 bp, Homo sapiens
  misc_feature: GZ8MTXP02JH10U.52.45.E01.1.454.CMB.2.raw
  modified_base (193)..(193): a, c, t, g, unknown or other
  misc_feature (193)..(193): n is a, c, g, or t
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtctgggccccagggcaggaggtcaaccatctcctgcacgtggancagctcaacatcggggcagggtttanatagtatacgtgacagcagtccgtacgaacaccgaccccaactcctacacttacgttagtaacagtacctaacgtccgtcccgtccgggtcctacgacgtctcctacgtcgcctacgtaacgtctacgacctacctacgaccgcctccgtacgacacgtcgacgtcgggacctacgagtacgtaggaacgtacgtaggacggtactagtaactttacgtactacgaccgtaacgtactagtacgaacgtacgacacgtacgttacggtacgttcggtttacgtttaacgggttacgttaacggtaacggtaccggtaaccggtaacggtaccgtacg

SEQ ID NO: 316275 - DNA, 767 bp, Homo sapiens
  misc_feature: GZ8MTXP02GEMM5.52.45.E01.1.454.CMB.2.raw
  modified_base (306)..(306): a, c, t, g, unknown or other
  misc_feature (306)..(306): n is a, c, g, or t
tcagcgcagtacgacacgaccggtgctcgatttagtgagtcagtaagggaaagggggaggctctgcttcagctgtgggcacaagaggcagcactcaggacaatctccagcatggcctggtctcctctcctcctcactctcctcgctcactgcacgagggtcctgggacccagtctggtgctgacgcacgcccgcctcagttgtaccgtcggggaccccagggcaggtacgggtcaccagtcctccgtgaccgtacgtagggacgaccgtagccctacccgaaacgcgtccggggcttagggttttntagttaggtataccgttcggtaccaggacgtaccgtaccggttaacccggacaaaccccgtaccccccgtaaaaccttcccctacgtactttacgttaacggaaactacgacccgtaaacgtcccgggtccccggtaccccgggttcccacggtacccggttacttccgtacgtcgtccctacgtacgttacccgtggtacctacctccgaccgtcccgtaccgtaccgtcccacgtaccgtacgtccgaccgtaccgaggtcgtaggacggtacgtacggtaggtacttaacgttacgtttaaccgttaccggtaccgtaccgttaaccgtaccgtacgtacggaacgtacgaccgtacgttaccgttacggttcggtttacgtttttcggggttaacgggtttaccggttaacgggttaccggtaaccgggtaaccggtaaccgttacccggtaaccgg

SEQ ID NO: 316276 - DNA, 537 bp, Homo sapiens
  misc_feature: GZ8MTXP01BZXVM.51.19.B08.1.454.CMB.2.raw
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccagcaaagccccaaagtcatattatgagccagtaggcgagctcaggatttctagtcgccttctctcgccctccgcgtctggcaaacaccggcctccctgactaatttctggctccagccctgacggacgagtctcactactactcgctctcatatcgcacgactaaatacgtttcctggtcggttcggcgggtaacgggacctaggttcgaccgttcttaaggttcacgcccaacgggtcctcggcccccttcggtaaccttcgttcccg

SEQ ID NO: 316277 - DNA, 520 bp, Homo sapiens
  misc_feature: GZ8MTXP01ADKX3.51.19.B08.1.454.CMB.2.raw
  modified_base (380)..(380): a, c, t, g, unknown or other
  misc_feature (380)..(380): n is a, c, g, or t
  modified_base (513)..(513): a, c, t, g, unknown or other
  misc_feature (513)..(513): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattatttatgaggccagtaggcgagccctcgagggtatttctagtcgtccttctctgcctccgcgtctggcaacacggcctcctgacatttcnggctcagcctgaggacagtctcactactactgctctcatatgcagactaaattagtttccctgggtcgttcgggcgggtagggacctaagttcgacccgtcgttaggttcagcccaggctcgccccttgtccncgttccg

SEQ ID NO: 316278 - DNA, 510 bp, Homo sapiens
  misc_feature: GZ8MTXP01BHK6D.51.19.B08.1.454.CMB.2.raw
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattattatgaggccagtaggcgagcctcagggtatttctagtcgcttctctgcctccgcgtctggcaaacacggcctccctgacaatttctgggctcagcctgaggacgagtctcactactactgctctcatatgcagacaatacgtttcctggtgttcggcggagggaccaagttgaccgtcttaggttcagcccaaggctcgccccttcggtccaacttccg

SEQ ID NO: 316279 - DNA, 508 bp, Homo sapiens
  misc_feature: GZ8MTXP01BVHD6.51.19.B08.1.454.CMB.2.raw
  modified_base (371)..(371): a, c, t, g, unknown or other
  misc_feature (371)..(371): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattattatgagccagtagcgagcctcagggatttcagtcgccttctctgcctcgcgtctggcaacacggcctcctgacaatttcnggctcagcctgagacgagtctcactactactgctcctcatatgcagacaatagtttcctggtgttcgggcggagggacctaaagttcgaccgtcttagggttcacgcccaaggcctcgccccttggtccaacgttcc

SEQ ID NO: 316280 - DNA, 510 bp, Homo sapiens
  misc_feature: GZ8MTXP01DX930.51.19.B08.1.454.CMB.2.raw
  modified_base (503)..(503): a, c, t, g, unknown or other
  misc_feature (503)..(503): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgagccagtaggcgagcctcagggatttctagtcgccttctctgcctccgcgtctggcaacacggcctccctgactaattctggctccagcctgaggacgagtctcactactactgctcctcatatgcagacaatagtttcctggtgttcggcggtaggaccaagttcgaccgttcaggttcacgcccaagcctcgccccttggtccncgttccg

SEQ ID NO: 316281 - DNA, 509 bp, Homo sapiens
  misc_feature: GZ8MTXP01BKPWB.51.19.B08.1.454.CMB.2.raw
  modified_base (502)..(502): a, c, t, g, unknown or other
  misc_feature (502)..(502): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattattatgagccagtaggcgagcctcagggtatttctagtcgtccttctctgcctccgcgtctggcaacacggcctcctgacattctgggctcacgcctgacggacagtctcactactactgctctcatatgcagacaattacgttcctggtgttcggcggagggaccaagttgacccgtcttaggttcagcccgaagcctcgccccgttcgtcncgtcccg

SEQ ID NO: 316282 - DNA, 521 bp, Homo sapiens
  misc_feature: GZ8MTXP01DJ6LZ.51.19.B08.1.454.CMB.2.raw
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
  modified_base (515)..(515): a, c, t, g, unknown or other
  misc_feature (515)..(515): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgcccccaaagtcaattattatgaggccagtaggcgagcctcagggatttcagtcgcttctctgcctccgctctggcaacacggcctccctgactatttcnggctcagcctgaggacagtctcactctactgctcctnactatgccagactaaattacgttcctgggtcgttcgggcggtaagggacctaagttcgaccgtccttagggttcaacgcccaaggctcgccccgttcggtcncgttcc

SEQ ID NO: 316283 - DNA, 542 bp, Homo sapiens
  misc_feature: GZ8MTXP01EHK96.51.19.B08.1.454.CMB.2.raw
  modified_base (370)..(370): a, c, t, g, unknown or other
  misc_feature (370)..(370): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctgaccaacaacaccaggcaaagccccaaagtcattattatgagccagtaggcagcctcagggatttcagtcgtcttctctgccctcgcgtctgggcaacacggcctccctgactaatttcngggctcagcctgaggacgagtctacactactactcgcttcctcatagtgcagactaattacgttccgtaggtgttcgggcggtaagggacctaaaggtttcgaacccgttcgttagggttccacggccccgaagggtcctacggtcccccttcgggtccgttaacgttcccg

SEQ ID NO: 316284 - DNA, 508 bp, Homo sapiens
  misc_feature: GZ8MTXP01AZS2L.51.19.B08.1.454.CMB.2.raw
  modified_base (374)..(374): a, c, t, g, unknown or other
  misc_feature (374)..(374): n is a, c, g, or t
  modified_base (501)..(501): a, c, t, g, unknown or other
  misc_feature (501)..(501): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggaccaacaacacccaggcaaagcccccaaagtcattattatgaggccagtaggcgagcctcagggatttctagtcgccttctctgcctccgcgtctggcaacacggcctcctgacatttcnggctcagcctgaggacgagtctcactactactcgctcctcatactgcagacaatagtttcctggttcgttcggcggaggaccaagttgaccgtccttaggttcagcccaggctcgccccttcggtcncgttccg

SEQ ID NO: 316285 - DNA, 521 bp, Homo sapiens
  misc_feature: GZ8MTXP01EE0A2.51.19.B08.1.454.CMB.2.raw
  modified_base (379)..(379): a, c, t, g, unknown or other
  misc_feature (379)..(379): n is a, c, g, or t
  modified_base (514)..(514): a, c, t, g, unknown or other
  misc_feature (514)..(514): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctgaccaacaacaccagacaaacgccccaaagtcattattatgagcagtaggcgacgcctacgaggtatttcgtagtcgtccttctctcgccctccgcgtctggcaacgaccggcctcctgactaattcgnggctccgagcctagacggacgagtctacactactactgcctctcatactgcagactaaattcgttcctggtcgtcggcggaacggacctaagttcgacccgtcgaggttcacgcccaggccctcgccccttgtcncgttccg

SEQ ID NO: 316286 - DNA, 543 bp, Homo sapiens
  misc_feature: GZ8MTXP01C30WL.51.19.B08.1.454.CMB.2.raw
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (536)..(536): a, c, t, g, unknown or other
  misc_feature (536)..(536): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctgtaccaacaacaccaggacaaacgccccaaagtcattattatgaggccagtaggcgacgcctcagggtatttcgtagtcgtccttctctgccctccgcgttctggccaacnccggcctccctgacaatttcnggcctcagcctgaggacgagtcctcactactactcgctcctcaattactgccagactaattacgtttctgggtcgttcgggcggtaggaccgtaaagttcgaaccgtcgttaagggttcacggccctaagggccttcggcccccttggtccncttcccg

SEQ ID NO: 316287 - DNA, 511 bp, Homo sapiens
  misc_feature: GZ8MTXP01ACOGV.51.19.B08.1.454.CMB.2.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (507)..(507): a, c, t, g, unknown or other
  misc_feature (507)..(507): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgtcctgactcagcctgcctccgtgtctgggtctcctggacagtccatcaccatctcatgcactggaaccagccgtgatattgggacttatcaccttgtctcctggtaccaacaacaccaggcaaagcccccaaagtcattattatgagccagtaggcgagcctcaggtatttcagtcgcttctctgcctcgcgtctggcaacacggcctccctgacaatttctgggctccagcctgaggacagtctcactactactgctcctnagttangcagtactaattcgttcgtggtcgtcggcggtacggacctaagttcgaccgtcgttacggcacgaaccagcctccgccccgttcgtccnctcg

SEQ ID NO: 316288 - DNA, 520 bp, Homo sapiens
  misc_feature: GZ8MTXP01DKYIC.51.19.B08.1.454.CMB.2.raw
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
  modified_base (513)..(513): a, c, t, g, unknown or other
  misc_feature (513)..(513): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcatatttatgaggccagtaggcgagcctcgaggatttctagtcgccttctctgcctccgcgtctggcaacacggcctccngacaattctgggctccagcctgaggacgagtctcactactactcgctccctnatatgcagacaaattacgtttcctggtgttcgggcggtagggaccctaaggttcgaccgtcttaggttcagtcccaaggctcgccccttcggtcncgttccg

SEQ ID NO: 316289 - DNA, 500 bp, Homo sapiens
  misc_feature: GZ8MTXP01BGAKL.51.19.B08.1.454.CMB.2.raw
  modified_base (314)..(314): a, c, t, g, unknown or other
  misc_feature (314)..(314): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatttcatgcactggaaccagccgtgatattgggacttatcaccttgtctcctggtaccaacaacacccaggcaaagcccccaaagtcattattatgagccagtaggcgagcctnagggatttctagtcgcttcctctgcctcgcgtctggcaacacggcctccctgacatttctgggctcagcctgaggaccgagtctcactactactgcctctcatatgcagacaatgttctggtgttcggcgaaggaccaggttnccgtctggttcngcccaagctcgcccctcggcncgttctcccg

SEQ ID NO: 316290 - DNA, 573 bp, Homo sapiens
  misc_feature: GZ8MTXP01B2K37.51.19.B08.1.454.CMB.2.raw
  modified_base (298)..(298): a, c, t, g, unknown or other
  misc_feature (298)..(298): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggacttatctaccttgtctcctgaccaacaacaccaggacaaacgaccccaaagtcattattangacgcagtaggcgagcctgaggtatttctagtcgtccttctctcgccctccgcgtctcggacaacgaccggccctccgtgactatttcgcggcctcgacgccgtaggacggacgtagtctcactactactcgtcctcctatatatcgacaagactaaagtttcgtttccgtgggttcgttcgggaacgggtaacggttaccgtaaggttccgaaccgttcgttacggttcacggtcccacgggcctccggcccccgttggtccttaacgttcccg

SEQ ID NO: 316291 - DNA, 573 bp, Homo sapiens
  misc_feature: GZ8MTXP01D9RF5.51.19.B08.1.454.CMB.2.raw
  modified_base (292)..(292): a, c, t, g, unknown or other
  misc_feature (292)..(292): n is a, c, g, or t
  modified_base (385)..(385): a, c, t, g, unknown or other
  misc_feature (385)..(385): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctggaccaacaacaccagacaaacgccccaaagtctatattangagccagtaggcgagcctcgagggtatttctagtcgtcccttctctcgccctccgcgtctggacaacgccggacctccctgactaactttcgngggctccagtcctagacggacagtcctacactactactcgtctctacactatcgacagtaactaaagttcgtttccgtggttcgttccggggaacgggtacgggaccctaaggttcgacccgttacgttacggttccacggaacccgtaaggcccgttacggcccccttaggtcccaaccgtttcccg

SEQ ID NO: 316292 - DNA, 552 bp, Homo sapiens
  misc_feature: GZ8MTXP01C84AR.51.19.B08.1.454.CMB.2.raw
  modified_base (293)..(293): a, c, t, g, unknown or other
  misc_feature (293)..(293): n is a, c, g, or t
  modified_base (445)..(445): a, c, t, g, unknown or other
  misc_feature (445)..(445): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcaccttgtctctgtaccaacaacacccaggcaaacgccccaaagtcatatttangagccagtaggcgagcctcgagggtatttcgtagtcgtcttcctctcgccctccgcgtctggaccaacgaccggtccctccctagtactaatttcgtgggcctccgagtcctaggaggacgagttcctacactactactcgcttctctaatntcgacacgtactaagttcgtttcgtggttcggtcgggcgggtacggttaccgtagttcgtaccgtcgttacggcacgccgagccgtccgtcccgttcgtccttcgtc

SEQ ID NO: 316293 - DNA, 563 bp, Homo sapiens
  misc_feature: GZ8MTXP01EFPSP.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggacttatctaccttgtctcctgtaccaacaacaccagacaaacgccccaaagtcattattatgagcagtagcgagcctcgaggtatttctagtcgtccttctctcgccctccgtcgtactcggaccaaaccgcccggccctcccgtagacctaactttcgcgggcctccgagtcccgtggaacggtacgtagtcctacaccttactactctacctcctcatagtcgcaagtacctaaattcgtttccgtgggtgttcgggcggaggacctaaggttcgaccgtcttaggttcacgcccaggtcctcgccccgttgtccttcgttcccg

SEQ ID NO: 316294 - DNA, 523 bp, Homo sapiens
  misc_feature: GZ8MTXP01EZCCN.51.19.B08.1.454.CMB.2.raw
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgagccagtaggcgagcctcgagggtatttctagtcgccttctctgcctccgcgtctggcaacacggcctcctgacatttcnggctccagcctgagacgagtctcactactactnctctcattangacagactaagttcgttcgtggtcggtcgggcgggtaacggaccgtaggttcgaccgtcgacgttcacgaacccgagtcctccgccccgttcgtcttccgtcg

SEQ ID NO: 316295 - DNA, 590 bp, Homo sapiens
  misc_feature: GZ8MTXP01EQL1S.51.19.B08.1.454.CMB.2.raw
  modified_base (441)..(441): a, c, t, g, unknown or other
  misc_feature (441)..(441): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctgaccaacaacaccagacaaacgccccaaagtcattattatgagcagtgcgagctcgaggtattctagtcgccttctctgtccctcgcgtctggcaacgaccggcctccgtgactactttcgtcgggtcctccgagtccgtggaacggacgtacgttctacacctaactactcgtccttcctctattacncgacacgtaacttaagttacgtttcgtacgggttcggttcgggaacgggtaacgggttacgtaacggttaccggtaccggttaccgttacggttccgaccggtaacccgacggtcccgtcccggtccccgttacgtccgttccgttccg

SEQ ID NO: 316296 - DNA, 566 bp, Homo sapiens
  misc_feature: GZ8MTXP01BCYIS.51.19.B08.1.454.CMB.2.raw
  modified_base (375)..(375): a, c, t, g, unknown or other
  misc_feature (375)..(375): n is a, c, g, or t
  modified_base (421)..(421): a, c, t, g, unknown or other
  misc_feature (421)..(421): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctggaccaacaacaccagcaaacgccccaaagtcattattatgagccagtaggcgacgcctcgagggtatttctagtcgccttctctgccctccgcgtctgcaacgacgcctcctgactatttcngggcctccgagcctagacggacgtgtctcactactactcgctcctnatatgcagtactaagttacgtttcccgtgggttcggttccgggcgggtaacggggttacctaaaggtttcggaacccggttccgttacgggttcacggccccgaaggccttaccggcccccgttcgggtcccttaacgtttcccg

SEQ ID NO: 316297 - DNA, 633 bp, Homo sapiens
  misc_feature: GZ8MTXP01BRN3K.51.19.B08.1.454.CMB.2.raw
  modified_base (299)..(299): a, c, t, g, unknown or other
  misc_feature (299)..(299): n is a, c, g, or t
  modified_base (444)..(444): a, c, t, g, unknown or other
  misc_feature (444)..(444): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggactttatctaccttgtctcctggtaccaacaacaccagacaaacgccccaaagtcattattangagcagtaggcgagcctgaggtatttcagtcgtccttctctcgccctccgcgtctggaccaacgaccggccctcccgtagtactaacttttccgcgggccttccgacgtccctaggacggtacgtagtcctacaactactactcncttcctctaagtactcaccaagtacctaaagttcggtttccctagggttcggttccggggaacgggtaacgggttacccttaaaggttccggtacccgttaccgttaacgggttcccaaacgggtccccgaaaggggtcccctttccccggacccccgtttcgggtaacccttaacccgttttccccgg

SEQ ID NO: 316298 - DNA, 573 bp, Homo sapiens
  misc_feature: GZ8MTXP01EMOL7.51.19.B08.1.454.CMB.2.raw
  modified_base (380)..(380): a, c, t, g, unknown or other
  misc_feature (380)..(380): n is a, c, g, or t
  modified_base (422)..(422): a, c, t, g, unknown or other
  misc_feature (422)..(422): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggacaaacgcccccaaagtcattattatgagccagtaggcgagcctgaggtatttctagtcgccttctctgccctccgcgtctggcaacacggcctcctgactaatttcngggctccagcctgacggacgagtctcactactactcgctctnatatgcagactaagttacgtttccgtggttcggttcggggcgggtaacgggttacccgtaaaggtttcggaaccccgttccgttacgggttccacggtccccgaaagggtccttcccggcccccgttcgggttcccttaaccgtttccccg

SEQ ID NO: 316299 - DNA, 556 bp, Homo sapiens
  misc_feature: GZ8MTXP01BLP2G.51.19.B08.1.454.CMB.2.raw
  modified_base (373)..(373): a, c, t, g, unknown or other
  misc_feature (373)..(373): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctaccctgactcagcctgcctccgtgtctgggtctcctggacagtccatcaccatctcatgcactggaaccagccgtgatattgggacttatcaccttgtctcctggtaccaacaacacccaggcaaagccccaaagtcattattatgagccagtaggcgagcctcagggtatttctagtcgcttcctctgcctcgcgtctggcaacacggcctcctgacatttcnggctccagcctgaggacgagtctcactactactgcctccgtcatatgactagactaattagttcctgggtgttacgggcggaagggtcccttaaggttcgacccggttaccgtacggttccgacggccccgtaaaggggccttccggccccccgtgggttccctaaccgttccgtttccccgg

SEQ ID NO: 316300 - DNA, 530 bp, Homo sapiens
  misc_feature: GZ8MTXP01EG5E4.51.19.B08.1.454.CMB.2.raw
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
  modified_base (440)..(441): a, c, t, g, unknown or other
  misc_feature (440)..(441): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaaacaacacccaggacaaacgcccccaaagtcattattatgaggccagtagcgagcctcgaggtatttctagtcgtccttctctgccctccgcgtctggacaacgaccggccctccctgactaatttcgngggcctccgagcctagaggacagtcctacactactactcncctctcattannacagactagttcgttcgtggtcgtcgggaaggacggactagttcgaccgtcttagcacgccagtcctccgcccgttcgtccttcgtccg

SEQ ID NO: 316301 - DNA, 738 bp, Homo sapiens
  misc_feature: GZ8MTXP01CS9TF.51.19.B08.1.454.CMB.2.raw
  modified_base (273)..(273): a, c, t, g, unknown or other
  misc_feature (273)..(273): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctgaccaacaacaccagacaaacnccccaagtcatattatgagcagtagcgagcctcgaggtatttctagtcgtccttctctcgccctccgcgttctcggctaaaccgaccgggtccctcccgtacggtaacctaaattttccgtcggggtccttacccgtaacggccccttaggaacgggtaaccgtaggttaccttccgtaaaccttaacctaaccttccggtaccttccccgtttaccctaattaaacttcggtaaccaaacggtaaccttaaaacgtttacggtttttaccccgttagggggtttacgggtttcccgggggaaccgggggtaaacgggggaaacccttaaacggggtttccggtaaacccccgggtttcgttaaccgggggtttcccttaaaccgggtaaccccgaaaaccggggttcccttaccccggtccccccggttacccgggttaaccccgttaaccgttttccccccgg

SEQ ID NO: 316302 - DNA, 509 bp, Homo sapiens
  misc_feature: GZ8MTXP01BGKGC.51.19.B08.1.454.CMB.2.raw
  modified_base (376)..(376): a, c, t, g, unknown or other
  misc_feature (376)..(376): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggacaaagcccccaaagtcaattattatgagccagtaggcgagcctcgaggatttctagtcgcttctctgccctccgcgtctggcaacacgcctcctgactaattcnggctcagcctgaggacgagtctcactactactgctctcatagtgcagacaatacgttcctggtcgttggcggagggaccaaagttcgaccgtcttacggttcacgccaggctcgccccgttcggtcaacttcc

SEQ ID NO: 316303 - DNA, 504 bp, Homo sapiens
  misc_feature: GZ8MTXP01E0JNI.51.19.B08.1.454.CMB.2.raw
  modified_base (371)..(371): a, c, t, g, unknown or other
  misc_feature (371)..(371): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctgtaccaacaacacccaggcaaagcccccaaagtcattattatgagccagtaggcgagctcaggatttctagtcgccttctctgcctccgcgtctggcaacacggcctccctgacaattcngggctccagcctgaggacagtctcactactactgctctcactatgcagacaatgttcnggtgtcggnggaggccaaagttgaccgtccttaggttcacgtcccaaggcctcgccccttcggtccaacgtcccg

SEQ ID NO: 316304 - DNA, 524 bp, Homo sapiens
  misc_feature: GZ8MTXP01BTV3V.51.19.B08.1.454.CMB.2.raw
  modified_base (380)..(380): a, c, t, g, unknown or other
  misc_feature (380)..(380): n is a, c, g, or t
  modified_base (517)..(517): a, c, t, g, unknown or other
  misc_feature (517)..(517): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctggaccaacaacacccaggcaaacgcccccaaagtcattattatgaggccagtaggcgagcctcgagggtatttctagtcgtccttctctcgccctccgcgtctggcaacacggcctcctgactatttcnggctccagcctgacggacgagtctcactactactgctctcatatgcagactaaattcgtttccgtggttcgttcggcgggaagggacctaaagttcgaccgtcttacggttcacgtccaggctcgccccttggtccncgttccg

SEQ ID NO: 316305 - DNA, 689 bp, Homo sapiens
  misc_feature: GZ8MTXP01CS8E3.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcaccttgtctctgaccaacaacaccagacaaacgcccccaagtcattattatgagccagtaggcgagcctcgaggtatttcgtagttccgtcctttctctcgtccctcccgtcgttctcggtaccaaaccgacccgggtccctccccgtaggacctaaacgttttccgtcggggtccctccgagtccccgttaggaacgggacgtacgttcctacctaacgttacctactcggtccttccctactacttactcgaccgtaagtaacctaaacgtttacgttttaccgttcgggtttcggtttccggggaaccggggtaacggggttaaacccgttaaacgggtttccggtaaaccccggttccgttaacgggttcccgaaccggtccccggtaaacgggtcccgttacccggtccccccccgttgggttccccttaaccgttttcccccg

SEQ ID NO: 316306 - DNA, 570 bp, Homo sapiens
  misc_feature: GZ8MTXP01BDCA7.51.19.B08.1.454.CMB.2.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgcccccaaagtcattattatgagccagtaggcgagcctcgaggatttcgtagtcgccttctctgcctccgcgtctggcaacacggcctcctgacatttcnggctcagcctgagacgagtcncactactactgcctctcatacgtgacacgtaactaaacgtttcgtttccgttgggtcggttcgggcgggtaacgggttaacctaagggttccgtacccgggttaccgttacggttccgacgaaccccgaaggtcccgtcccgtccccgttccggtccgttaacctttccccg

SEQ ID NO: 316307 - DNA, 545 bp, Homo sapiens
  misc_feature: GZ8MTXP01CMY44.51.19.B08.1.454.CMB.2.raw
  modified_base (309)..(309): a, c, t, g, unknown or other
  misc_feature (309)..(309): n is a, c, g, or t
  modified_base (422)..(422): a, c, t, g, unknown or other
  misc_feature (422)..(422): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctaccctgactcagcctgcctccgtgtctgggtctcctggacagtccatcaccatctcatgcactggaaccagccgtgatagttgggacttatcacttgtctctgtaccaacaacaccagcaaagcccccaaagtcattattatgagcagtagcgagcctnagggatttctagtcgtcttcctctgcctccgcgtcctggcaaacaccgggcctccctgactaatttctgggctccagcctgaggacgagtctcactactactgcctcctcatntgcagactaattacgtttccgtggtgttcgggcgggaagggaaccaggttcgaccgttccgtaggttcgcggttaccccaaggccttccgcccccgttggttcctaaccgttccgtttccccg

SEQ ID NO: 316308 - DNA, 533 bp, Homo sapiens
  misc_feature: GZ8MTXP01EQI8S.51.19.B08.1.454.CMB.2.raw
  modified_base (374)..(374): a, c, t, g, unknown or other
  misc_feature (374)..(374): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctgaccaacaacacccagacaaacgccccaaagtcattattatgagccagtaggcgagcctcagggtatttctagtcgtcttctctgccctccgcgtctggcaacacgcctcctgactattcngggctcagcctgacggcgtagtctacactactactcgctctcatagtcgcagtactaaattacgtttccgtggtcgttcggaacgggtaggaccgtaagttcgaccgtcttaggttcacgcccgaagccgtcgccccgttcggtccgttaacgttcccg

SEQ ID NO: 316309 - DNA, 531 bp, Homo sapiens
  misc_feature: GZ8MTXP01A3ILK.51.19.B08.1.454.CMB.2.raw
  modified_base (414)..(414): a, c, t, g, unknown or other
  misc_feature (414)..(414): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgagccagtaggcgagcctcaggatttctagtcgccttctctgcctccgcgtctggcaacacggcctccgacaatttctgggctccagcctgaggacgagtctcactactactgctcctnatatgcagacaagtagtttcctgggtgttcgggcggaacgggaccaaaggtttcgaaccgttccgtaagggttcacgccccaagggcctcgcccccgtcggttcaaccttcgtcccg

SEQ ID NO: 316310 - DNA, 562 bp, Homo sapiens
  misc_feature: GZ8MTXP01EEI7N.51.19.B08.1.454.CMB.2.raw
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctggtaccaacaacacccaggcaaacgcccccaaagtcattatttatgagccagtaggcgagcctcagggtatttcgtagtcgtccttctctgccctccgcgtctggcaacacggcctccctgactaatttcnggctcagcctgaggcagtctcactactactgccttcctcattacncgacaagtaactaagttcgtttccgtgggttcggtcgggaacgggtaacggaccgtaaggttccgtacccgttacgttacggttccgaccggaacccgacggtccctcccggccccgttcggtccttccgttccg

SEQ ID NO: 316311 - DNA, 504 bp, Homo sapiens
  misc_feature: GZ8MTXP01BPY5U.51.19.B08.1.454.CMB.2.raw
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
  modified_base (500)..(500): a, c, t, g, unknown or other
  misc_feature (500)..(500): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattattatgaggccagtaggcgagcctcagggatttctagtcgccttctctgcctccgcgtctggcaacacggcctccctgacatttcngggctccagcctgaggacgagtctcactactactgctcctcatatgcagacaatagttcctggtgttcggnggtagggaccaagttgaccgtcttaggttcagcccaggctcgccccttcggtcncgtc

SEQ ID NO: 316312 - DNA, 586 bp, Homo sapiens
  misc_feature: GZ8MTXP01BDJNH.51.19.B08.1.454.CMB.2.raw
  modified_base (378)..(378): a, c, t, g, unknown or other
  misc_feature (378)..(378): n is a, c, g, or t
  modified_base (473)..(473): a, c, t, g, unknown or other
  misc_feature (473)..(473): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactgaaccagccgtgatattgggacttatctaccttgtctcctgaccaacaacaccagacaaacgccccaaatcattattatgagcagtaggcgacgctcgaggtatttctagtcgtccttctctcgcctccgcgttctcggcaacgcgcctccctagactactttcngggacctccgtagcctagacggactagtcctacactactactcgtctctactatatgactagactaaacttgtttccgtgggttcggttccgggngggtaaccgggacccgtaaaggttccgtaacccggttcgttacggttccgaaccggtaaccccgaagggtccctccccggcccccgttaccgggtccttaacccggttccccg

SEQ ID NO: 316313 - DNA, 525 bp, Homo sapiens
  misc_feature: GZ8MTXP01CU3U6.51.19.B08.1.454.CMB.2.raw
  modified_base (428)..(428): a, c, t, g, unknown or other
  misc_feature (428)..(428): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggaccaacaacacccaagcaaagcccccaaagtcattattatgagccagtagcgagctcaggattctagtcgccttctctgcctccgcgttctggcaaacacggccctccctgaacaatttctgggctccagcctgaaggacgatctcactactactgctcctctaatatgcaanaactaatacgttcgtgtggtcggtcggacggacgtacgttacgtacgtacgttacgttcgacgaaccgacgtcgtccgtcccgttccgtcgttcgtc

SEQ ID NO: 316314 - DNA, 535 bp, Homo sapiens
  misc_feature: GZ8MTXP01BOAZH.51.19.B08.1.454.CMB.2.raw
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
  modified_base (455)..(455): a, c, t, g, unknown or other
  misc_feature (455)..(455): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctgtaccaacaacaccaggcaaacgccccaaagtcattattangagcagtagcgagctcgaggtatttcagtcgtccttctctcgcctccgcgtctggcaacacggcctccctgactatttcgnggcctcagcctagacggacacgtcacactatactcgctactcatatgcagactaaattcgtttccgtgggtcgttcgggngggacggacctaaggtttcgaacccgtcgttaacggttcacgcccgaagtcctccgccccgttcggtccttcgtttcccg

SEQ ID NO: 316315 - DNA, 507 bp, Homo sapiens
  misc_feature: GZ8MTXP01A13WV.51.19.B08.1.454.CMB.2.raw
  modified_base (376)..(376): a, c, t, g, unknown or other
  misc_feature (376)..(376): n is a, c, g, or t
  modified_base (501)..(501): a, c, t, g, unknown or other
  misc_feature (501)..(501): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattattatgaggccagtaggcgagcctcagggatttctagtcgccttctctgcctccgcgtctggcaacacggcctcctgactaatttcnggctcagcctgaggacgagtctcactactactgctctcatatgcagacaatagttcctggtcgttcggcgagggaccaagttcgaccgtcaggttcacgcccaaggcctcgcccccttgggtccncgttcc

SEQ ID NO: 316316 - DNA, 567 bp, Homo sapiens
  misc_feature: GZ8MTXP01DID1L.51.19.B08.1.454.CMB.2.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactaggaaccagccgtgatagttgggactttatctaccttgtctcctggaccaacaacacccaggaccaaacgccccaaagtctattatttangacggccagtaggcgacgcctcgagggtntttctagtcttccttctctcgcctccgcgtctgcaacncggcctcctgactattcgtggacctcgacgcctgacggacgtacgtcctactactactactcgcttcctctatacgtcgacagtactaaacgttcgtttccgtggtcgttcgggaacggtacgggacctaaggttcgaccgttcgttaggttccacgtcccaagggcctcccggccccttcggtccttccgttcccg

SEQ ID NO: 316317 - DNA, 507 bp, Homo sapiens
  misc_feature: GZ8MTXP01D9VSO.51.19.B08.1.454.CMB.2.raw
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgagccagtaggcgagcctcagggatttctagtcgtccttctctgcctccgcgtctgcacacgcctcctgacattcnggctcagcctgaggacgagtctcactacactcgctcctcatntgcagacaattacgtttctggtgttcggcggagggacctagttgaccgtcgttagttcacgtccaaggctcgccccttcggtcaacgttccg

SEQ ID NO: 316318 - DNA, 549 bp, Homo sapiens
  misc_feature: GZ8MTXP01DMZRU.51.19.B08.1.454.CMB.2.raw
  modified_base (292)..(292): a, c, t, g, unknown or other
  misc_feature (292)..(292): n is a, c, g, or t
  modified_base (421)..(421): a, c, t, g, unknown or other
  misc_feature (421)..(421): n is a, c, g, or t
  modified_base (540)..(540): a, c, t, g, unknown or other
  misc_feature (540)..(540): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctggtaccaacacaccagcaaacgccccaaagtcattattangagccagtaggcgagctcgaggtatttcgagtcgtcttctctcgcctccgcgtctggcaacgaccggcctcctgactaattcgtggtctcgagcctgacggcgtacgtctcactactactcgcttcctntatactgcagtactaaattcgtttccgtgggttcgttccgggaacgggtagggaccgtaaggttcgacccgtcttacgggttcacggtcccaacggtcctcgtcccccgttcggttccncgtttcccg

SEQ ID NO: 316319 - DNA, 592 bp, Homo sapiens
  misc_feature: GZ8MTXP01DQ8MR.51.19.B08.1.454.CMB.2.raw
  modified_base (451)..(451): a, c, t, g, unknown or other
  misc_feature (451)..(451): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggactttatctaccttgtctcctaggtaacccaaacaaccacccaaggaccaaaacgcccccaaaagtccaattatttatgacggaccaggtaggcgagcctcgagggtatttctagtccgtccttctctcgccctccgctctggctaacgaccggccctccctgaactacttcgtggctcgagcctgaggtacgatctacactactactgtcctcctntaatctgaccagaactaaattgtttccgtggttggttcgggaacggtacgggactaaaggtttcgaaccgggttcgttacgggttcacggtccccgaaaggtcccgttccgggcccccttagggtcccaaccgtttccccg

SEQ ID NO: 316320 - DNA, 576 bp, Homo sapiens
  misc_feature: GZ8MTXP01EGZB0.51.19.B08.1.454.CMB.2.raw
  modified_base (220)..(220): a, c, t, g, unknown or other
  misc_feature (220)..(220): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccngccgtgatagttgggacttatctaccttgtctcctagaccaaacaacaccagacaaacgaccccaaagtcattattatgagaccagtagcgacgctcgaggtattctacgtcgtccttctcgtcgccctccgcgtctcggaccaaccgaccggccctaccctacgacttaatttccgtggactccgagccgtagacgacgtatctacactactactntcctcctagtattacganacgacgtaactaacgttacgttcgttcggttcggtcgggtaacgggtacggacgtacgttacgtaccgtacgttacgttcgacgaaccgacgccgtccgtcccgttccgtccgttcgtccg

SEQ ID NO: 316321 - DNA, 658 bp, Homo sapiens
  misc_feature: GZ8MTXP01CZ8KF.51.19.B08.1.454.CMB.2.raw
  modified_base (296)..(296): a, c, t, g, unknown or other
  misc_feature (296)..(296): n is a, c, g, or t
  modified_base (645)..(645): a, c, t, g, unknown or other
  misc_feature (645)..(645): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatctaccttgtctcctgtaccaacaacaccagacaaacgccccaaagtcattatttangacgccagtaggcgagcctcgaggtattctagtcgtccttctctcgccctccgtcgttcgtggaccaaaccgaccgggtccctcccgtagtacctaaactttccgtcgggtcctaccgacggtccctagggaacggtaccgtaacgttcctacctaactaaccttacgtcgtaccgttcctacgtatacgtgacctaacgaacttaaacgttcgtttccgtgggttcggttcggggccgggtaacgggttaccgttaaacggttaccggtaaacccgttccgttaaacgggttcccaccgggtaaccccgaaacgggtccctcccggtcccccccgttcgggttccccnccgttttccccgg

SEQ ID NO: 316322 - DNA, 599 bp, Homo sapiens
  misc_feature: GZ8MTXP01ERJGL.51.19.B08.1.454.CMB.2.raw
  modified_base (407)..(407): a, c, t, g, unknown or other
  misc_feature (407)..(407): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaaccaacaacacccaaggacaaacgcccccaaagtcattattatgagccagtaggcgagcctacgagggtatttcgtagtcgtcctttctctcgcccttcccggcgttctcgggccaaaccgaccgggtccctccctagactaatttccgngggtcctccgagtcctagacggacgtagtctacactactactcgcttcctcatactgacagactaaattacgtttccgtggttcggttcgggaacgggtaagggttaccctaagggtttcgacccggttccgttacgggttccaacggccccgtaaggcctcccggtccccttcggtaaccttccgttcccg

SEQ ID NO: 316323 - DNA, 649 bp, Homo sapiens
  misc_feature: GZ8MTXP01DXM9H.51.19.B08.1.454.CMB.2.raw
  modified_base (308)..(308): a, c, t, g, unknown or other
  misc_feature (308)..(308): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtagattagttgggactttatctaccttgtctcctaggtaaccaacaacacccaggaccaaacgacccccaaagtcattattangagccagtaggcgagcctcgaggtactttcgtagtcgtccttctctcgtccctccgacgttctcggaccaaaccgccggtccctcccgtagtactaatttccgcgggtcctccgagtcccgtaggaacggtacgtacgtcctacaaccttaactctctcctcctactaatacgtcgacctaagtaaccttaaagtttcgtttccgtgggttacggttccggggaacgggtaacgggttaccgttaaacgggttccgtaaacccggttccgttaacggggttccaccggcccgtaaacgggtccctcccggacccccgttcgtcccgttaaccgtttccccg

SEQ ID NO: 316324 - DNA, 774 bp, Homo sapiens
  misc_feature: GZ8MTXP01CXZ4Y.51.19.B08.1.454.CMB.2.raw
  modified_base (292)..(292): a, c, t, g, unknown or other
  misc_feature (292)..(292): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatctacttgtctcctgacaacaacaccagacaaacgccccaaatcattattangagcagtagcgagcctcgaggtatttctagtcgtccttctctcgccctccgtcgttcgtcggacctaaaccgacccgggtcccctacccgtacggtacctaaacgtttcccgtcggggtcccttacccgaacgggtccccgttaggggaaacggtacccgggtaacgttccccgttaaccgtaaacccgttaacccttaacctaccggttacccgtttcccccttaccgtaaagttaccgttacggacccgtaaacggtaaaccttaaaacgttttaaccggtttttccccggtaagggggtttcggggtttaacccgggggtccgggggtaaaccgggggttaaccccgttaaaaggggtttcccggtaaaccccgggttccgttaaccggggttaccgaaccgggtaaccccgaaacgggggttcccctacccgggtcccccccggtttcgggttaacccttaaccccgggttttccccg

SEQ ID NO: 316325 - DNA, 535 bp, Homo sapiens
  misc_feature: GZ8MTXP01DXUCB.51.19.B08.1.454.CMB.2.raw
  modified_base (384)..(384): a, c, t, g, unknown or other
  misc_feature (384)..(384): n is a, c, g, or t
  modified_base (527)..(527): a, c, t, g, unknown or other
  misc_feature (527)..(527): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatatgggacttatcacttgtctctgaccaacaacaccagacaaacgccccaaagtcattattatgacgccagtaggcgacgcctcgagggtactttcgagtcgtccttctcgtcgccctccgcgtctcggacaacgaccggcctccctagactattcgnggctcgagccgtagacggacgagtccacactactactcgccttctctatactgaccagaactaaattcgttcctgggttcgtcggaacggacggactaagttcgaccgtcttagttcacgccgaagcctcgccccgttgtccncgttcccg

SEQ ID NO: 316326 - DNA, 560 bp, Homo sapiens
  misc_feature: GZ8MTXP01DENJB.51.19.B08.1.454.CMB.2.raw
  modified_base (240)..(240): a, c, t, g, unknown or other
  misc_feature (240)..(240): n is a, c, g, or t
  modified_base (444)..(444): a, c, t, g, unknown or other
  misc_feature (444)..(444): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttancacttgtctctgaccaacacaccagcaaacgccccaaagtcattatttatgagccagtagcgagcctgagggtatttctagtccgtcttctctcgtccctccgcgtctggcctaaccgaccggtccctccctagactaactttcgtcgggctccgacgccgttaggagggtacgtagtcctacaaccttactactcgctcctanacgtatgacagaactaattcgtttccgtggtcgttcgggaacggtacgggactaagttcggaaccgtcttacgggttcacgcccgtaagcctccgccccttcggtccaacgttccc

SEQ ID NO: 316327 - DNA, 639 bp, Homo sapiens
  misc_feature: GZ8MTXP01DUOB1.51.19.B08.1.454.CMB.2.raw
  modified_base (221)..(221): a, c, t, g, unknown or other
  misc_feature (221)..(221): n is a, c, g, or t
  modified_base (501)..(501): a, c, t, g, unknown or other
  misc_feature (501)..(501): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctccgtggacagtccatcaccatctcatgcactggaaccngccgtagatagttggactttatctaccttgtctcctagaaccaacaacaccagacaaacgaccccaaagtctaattattagtgaacggccaggtacggcgacgtccgtacgtagggttactttacgtacgttccgtccttcctcgtcgtcccgtcccggcgttcgtcgggaccctaaaccgacccgggtccccttaccccgtagtaacttaacgtttccgcgggtcctccgagtccgtaggacggacgtactcctactaactactactcgtcctacctanaatacgtgacctaagtaacttaaagttcggtttccgtaggttcggttcgggaacggtacggaccgtaaaggttccgaaccgttcgttaacggttcaccgcccgtagcccgtccgcccgttcgtaaccttcgtttcccg

SEQ ID NO: 316328 - DNA, 533 bp, Homo sapiens
  misc_feature: GZ8MTXP01CN21T.51.19.B08.1.454.CMB.2.raw
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctgaccaacaacaccagcaaacgccccaaagtcattattatgagccagtaggcgagcctcgagggtatttctagtcgtccttctctcgccctccgcgtctggccaaacgaccggccctcctcgactaatttctggctccgagccctaggacgacgtagtctcactactactcgctcttcatntgacagactaaattcgtttcctgggtgttcggaacgggaggacctaagttcgaaccgtcttagggttcacgcccaaggctcgccccttggtccncttcccg

SEQ ID NO: 316329 - DNA, 595 bp, Homo sapiens
  misc_feature: GZ8MTXP01ET1I5.51.19.B08.1.454.CMB.2.raw
  modified_base (298)..(298): a, c, t, g, unknown or other
  misc_feature (298)..(298): n is a, c, g, or t
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggacaaacgcccccaaagtcattattangagccagtaggcgagcctacgaggtatttctagtcgtccttctctcgtccctccgcgtctggaccaacgaccggtccctccctagactaactttcgngggtcctccgagcccgtaggaacggacgtagtccacacctaactactcgtcctccctntattacgngaccagtaactaaagtttacgtttccgtgggttcggttccgggaacgggtaacggttaccgtaagtttcgacccggttcgttaagggttccacggcccgacgccgtccgccccttcggtccttaaccgttcccg

SEQ ID NO: 316330 - DNA, 566 bp, Homo sapiens
  misc_feature: GZ8MTXP01AP0HA.51.19.B08.1.454.CMB.2.raw
  modified_base (383)..(383): a, c, t, g, unknown or other
  misc_feature (383)..(383): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattattatgagccagtaggcgagcctcgagggtatttcgtagtcgtccttctctcgccctcgcgtctcggcaacgacggcctcctgactaattcnggctccgagcctagacggactagtcctacactactactgtcctctacatactgacagacctaatacgtttccgtaggttcgttcgggcggaacgggttaccgtaaaggttcgtaccggtccgttaggttccaccggtccccgtaaggcccgtcgcccccgttacgggtccttaaccgttcccg

SEQ ID NO: 316331 - DNA, 562 bp, Homo sapiens
  misc_feature: GZ8MTXP01DOMCB.51.19.B08.1.454.CMB.2.raw
  modified_base (442)..(442): a, c, t, g, unknown or other
  misc_feature (442)..(442): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctgaccaacacaccagcaaacgccccaaagtcattattatgagccagtaggcgacgctcgaggtatttcgtagtcgtccttctctcgccctccggcgtctcggacaaaccgaccggtcccctccctagtactaactttcgtgggtcctccgagccttaggacgtacgagtctacactactactcgctccctanatatgctaagactaaagttcgtttccgtggttcgttcgggaacggtacgggactaacggttcgtaaccgtccgttaggttcacgcccgaaggtcctcgccccgttcggtccaacgttccc

SEQ ID NO: 316332 - DNA, 633 bp, Homo sapiens
  misc_feature: GZ8MTXP01DXUD2.51.19.B08.1.454.CMB.2.raw
  modified_base (401)..(401): a, c, t, g, unknown or other
  misc_feature (401)..(401): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagcgtgatagttgggacttatctaccttgtctcctagtaccaacaacaccagacaaacgaccccaaagtcattattatgagcagtaggcgagcctcgaggtattctagtcgtccttctctcgccctccgccgttctcgggcaaaccgaccggtcccctcccgtagaactaacgttttccgngggcctccgagtccctaggacggacgtagtcctacacctaactctcgtaccttcctacgtaattactgacctaaggaaccttaaagtttccggtttccggttgggttcggttccggggaacgggtaacggttaaccgtaaacggttcggtaacccgttcgttaacggttccgaccggaacccgaacggtcccgtcccgtcccccgttgggtaacccttaaccggtttccccg

SEQ ID NO: 316333 - DNA, 561 bp, Homo sapiens
  misc_feature: GZ8MTXP01BDCJV.51.19.B08.1.454.CMB.2.raw
  modified_base (218)..(218): a, c, t, g, unknown or other
  misc_feature (218)..(218): n is a, c, g, or t
  modified_base (393)..(393): a, c, t, g, unknown or other
  misc_feature (393)..(393): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcacatctcatgcactggaaccngccgtagattattgggacttatcaccttgtctcctgaccaacacaccaggaccaaacgccccaaagtctattatttatgagccagtaggcgagcctacgagggtatttctagtcgtcccttctactcgccctccgcgttctggacaaaccgcggccctcctagacctaatttcgnggccttccgagccgtagacggacagtccacacttactcgtcncctctcattagngaccatacctaaagttcgttccgtggtcggttcggcggaacgggaccctaaggttcgacccgtacgacggttcacgcccgaggcccttcgccccgttacgtccaacgtttcccg

SEQ ID NO: 316334 - DNA, 516 bp, Homo sapiens
  misc_feature: GZ8MTXP01EDUGV.51.19.B08.1.454.CMB.2.raw
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggaccttatcaccttgtctcctggtaccaacaacacccaggcaaagcccccaaagtcatattatgagccagtaggcgagcctcgagggtatttctagtcgcttctctgcctccgctctggcaacacggcctcccngactaatttcnggtctcagcctgaggacgagtctcactactactgctcctcatatgcagacaaattgtttacctggttcgttcggcggtagggacaaagtttgaccgtcttaggttcagccgaagctcgccccttcggtccaacgttccg

SEQ ID NO: 316335 - DNA, 532 bp, Homo sapiens
  misc_feature: GZ8MTXP01B5KDU.51.19.B08.1.454.CMB.2.raw
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
  modified_base (524)..(524): a, c, t, g, unknown or other
  misc_feature (524)..(524): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggactttatctaccttgtctcctagtaccaacaacaccagaccaaacgaccccaaagtcattattatgagccagaggcagctcgaggtatttctagtcgtccttctctcgccctccgcgtctggcaacacggcctccngactattctggctcagcctgagacagtcncactactatcgctctcatatganacgactaaacttcgtttaccgtgggttcgttcgggaacggagggttacctaaggttcgaaccgtcttagggttcacggccacggcttccgccccttggtccncgttcccg

SEQ ID NO: 316336 - DNA, 598 bp, Homo sapiens
  misc_feature: GZ8MTXP01EBS5G.51.19.B08.1.454.CMB.2.raw
  modified_base (462)..(462): a, c, t, g, unknown or other
  misc_feature (462)..(462): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtcgtggtctccgtggacagtccatcaccatctcatgcactggaaccagccgtgatagttgggacttatctaccttgtctcctggtaccaacaacaccagacaaacgccccaaagtcattattatgagccagtaggcgagcctgaggtatttcgtagtcgtccttctctcgccctccgcgttctcggacaaccgaccggtccctccgtgaacttaacgtttcgcgggtcctccgagccgtaggacggacgtagtcctacgactactacgtcgtccttctactattacgngacaacgtaactaaacgtttcgtttccgtgggttcggttccgggaacgggtaacggaccgtaaggttcgaacccggttcgttaacgggttcaacgcccgtaagccttccggccccgttcggtccgaacctttcccg

SEQ ID NO: 316337 - DNA, 660 bp, Homo sapiens
  misc_feature: GZ8MTXP01DM0LO.51.19.B08.1.454.CMB.2.raw
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgtattagttgggacttatctaccttgtctcctagtaaccaacaacaccaggaccaaacgaccccaaagtctaattatttanagacgacagtacggcgacgccgtacgtaagggtactttcgtacggttccgtcccctttccttcgttccgtcccgttcccggtaaccggttccgtcggggaacccaaacccggtaccccgggtacccccttccccgtacggtaaaccttaaacgttttccgtcggggtaccctaccgacgtccgtaggaacggacgtacgtcctacactaactctcgccttctatagtancgacagtaacctaagttacgttcgtggttcggtcgggaacgggaacggttactaacggttcgaccggttcgacggttcacggaacccgaggccctaccgccccgttggtcccttaacgttcccg

SEQ ID NO: 316338 - DNA, 570 bp, Homo sapiens
  misc_feature: GZ8MTXP01ESG1T.51.19.B08.1.454.CMB.2.raw
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtagattagttgggacttactctaccttgtctcctaggtaccaaacaaccaccaaggacaaacgccccaaagtcattattangagcagtgcgagctgaggtattcagtcgtccttctctcgcctccgcgtctggacacgacggcctcctgactacttcgcggtcncgagccgtagacggacgtagtcctactactactactcgcttccctatactatgacagtaactaagttacgtttccgtagggttcggttcgggaacgggtacggttaccgtagttcgtacccgtcgttaggttccacggcccgtagccctaccgccccgttcggtaaccttccgtttccccg

SEQ ID NO: 316339 - DNA, 566 bp, Homo sapiens
  misc_feature: GZ8MTXP01EO80K.51.19.B08.1.454.CMB.2.raw
  modified_base (391)..(391): a, c, t, g, unknown or other
  misc_feature (391)..(391): n is a, c, g, or t
  modified_base (558)..(558): a, c, t, g, unknown or other
  misc_feature (558)..(558): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtagatattgggacttatctaccttgtctctagtaccaacaacaccaggacaaacgaccccaaagtcattattatgagccagtacggcgacgctacgagggtatttcgtacgtcgtccttctctcgccctccgcgtctcggacaaccaccggcctcctgactattcgnggcctcagcctggacggacgtagtcctacactactactgtcctcctatatagtcacgtacgtaactaaagttcgtttcccgtggggttcgtcgggaacggtacggacctaaaggttcgaccgttcgttaggttccaggtcccaggtcctccgtccccgttcggtccncgttcccg

SEQ ID NO: 316340 - DNA, 518 bp, Homo sapiens
  misc_feature: GZ8MTXP01EFYDT.51.19.B08.1.454.CMB.2.raw
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (415)..(415): a, c, t, g, unknown or other
  misc_feature (415)..(415): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatatgggacttatcaccttgtctctggaccaacaacacccaaggcaaacgcccccaaagtcattattangagccagtaggcgagcctcaggtatttctagtcgtcttctctgcctccgcgtctggcaacacggcctcctgacaatttcnggctcagcctgaggacagtctcactactactgctctcatntgcagacaaattcgtttccgtggtcgttcgggcggaaggacctaaagttcgaccgtcttaaggttcaaggcccaaggcctcgccccttggtccaacgttcccg

SEQ ID NO: 316341 - DNA, 608 bp, Homo sapiens
  misc_feature: GZ8MTXP01DBS6N.51.19.B08.1.454.CMB.2.raw
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatcncatgcactggaaccagccgtgatattgggacttatctactgtctctgaccaanacaccagcaaacnccccaaagtcattattatgagccagtaggcgagcctcgtaggtatttctagtcgtccttctctgccctccgacgttctcggacaaccgaccggtccctccctgaactaagtttcctgggtcctccgagtcccgtaggacggacgtagttcctacacctacttacgtcgtccttccctctaatcgtacgacaagacttaaactacggttttccctggggttcggttaccggggaacggtaacggggttacctaaagggttccgtacccgtcgttaacgggcgaacggtccccgaaggtcctcccggtacccccgttcgggttcccaaccgtttccccg

SEQ ID NO: 316342 - DNA, 555 bp, Homo sapiens
  misc_feature: GZ8MTXP01BH8X9.51.19.B08.1.454.CMB.2.raw
  modified_base (381)..(381): a, c, t, g, unknown or other
  misc_feature (381)..(381): n is a, c, g, or t
  modified_base (429)..(429): a, c, t, g, unknown or other
  misc_feature (429)..(429): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattattgggacttatctaccttgtctcctgtaccaacaacaccaggacaaacgccccaaagtcattattatgagccagtagcgagcctacgaggtatttctagtcgtccttctctgccctccgcgtctggcaacgacgcctcctgactaacttcnggtctcgagcctggacggtacgacgtctactactactactcgctcctnaacttagcacagtactaaatttacgtttcctggggttacgttcggggaacggtacgggacctaagttcggaccgtcgttaggttcacgcccgaagccttccgccccgttacggtccttcgttcccg

SEQ ID NO: 316343 - DNA, 729 bp, Homo sapiens
  misc_feature: GZ8MTXP01A9XUC.51.19.B08.1.454.CMB.2.raw
  modified_base (221)..(221): a, c, t, g, unknown or other
  misc_feature (221)..(221): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactcggaaaccngccgtgatattggggacttatcaccttgtctcctgaccaacaacacccagacaaacgccccaaagtcattattatgagccagtaggcgagcctacgaggtactttcgtagtccgtcctttctcgtcgccctccgtaaccgttccgtcgggacctaaaccgacccgggtccccttaccccgtagtaaaccctaacgtttttcccgacggggttacccttacccggaacgccccggtttaggaaaccggggtacccggttaacggttccccgttacccgaaacctttaaacccgttacgttcccgtccgttaaccccttacgtaatttaaccgcggtaactacgtaaactaaaacgttttcgtttccggtacggtttcggggttaccggaacggggtaaccggggttacttaaaccgggttcgtaccccggttcggttaaacgccgaaccggttaacccggaaacggtcccgtacccgtcccccgttacgggtccaacccgttttccccg

SEQ ID NO: 316344 - DNA, 589 bp, Homo sapiens
  misc_feature: GZ8MTXP01EXHJA.51.19.B08.1.454.CMB.2.raw
  modified_base (397)..(397): a, c, t, g, unknown or other
  misc_feature (397)..(397): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatccaccatctcatgcactggaaccagccgtagatattgggacttatctacttgtctctgaccaacacaccagacaaacgcccaatctattattatgacgcagtaggcgagcctagaggtacttcgtagtcgtccttctctcgtcctccgacgtcgtcggaccaaccgaccggtcccctccgtacgtactaacgtttccgngggtccctcacgtccgtaggaacggacgtatcctactaccgttacctacgtccacctcctactatactcggacaatacgtaactttcggttccgtggttcggtcgggaacgggtacggaccgtaagttcggcccgtagttacggttcacggcccgaggtccctccggccccgttacggtccttccgttcccg

SEQ ID NO: 316345 - DNA, 596 bp, Homo sapiens
  misc_feature: GZ8MTXP01DYG80.51.19.B08.1.454.CMB.2.raw
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (480)..(480): a, c, t, g, unknown or other
  misc_feature (480)..(480): n is a, c, g, or t
  modified_base (587)..(587): a, c, t, g, unknown or other
  misc_feature (587)..(587): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactaggaaccagccgtgtattattagggacttatctacttgtctctgaccaacacaccagacaacgccccaagtcattattangacgacgagtaggcgacgctgaggtnttcgtagtctccttctctcgtcccgtcccgtcgtctcgggaccaacccgtacccggtcccctccctacgtacttaacgtttccgcgggtccctacgacggtccgttagggaacggtaccgtatccctacctaaccttactactcgtccttactctatagtnacagtaacgtaattcggtttcctgggttcgtcgggtaacggaggttacttacgttcgaccgttcgttaaggttcacgaaccgacgtccttaccgccccgttggtccncgtttcccg

SEQ ID NO: 316346 - DNA, 557 bp, Homo sapiens
  misc_feature: GZ8MTXP01DMVLL.51.19.B08.1.454.CMB.2.raw
  modified_base (239)..(239): a, c, t, g, unknown or other
  misc_feature (239)..(239): n is a, c, g, or t
  modified_base (396)..(396): a, c, t, g, unknown or other
  misc_feature (396)..(396): n is a, c, g, or t
  modified_base (434)..(434): a, c, t, g, unknown or other
  misc_feature (434)..(434): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattggacttanctacttgtctctggaccaacaacaccaggacaaacgcccccaaagtcaattatttatgacggaccaaggtaggcgacgcctcgagggtactttacgtaggtctccttctctgcccttccgcgtctggacaaacgaccggcctccctagactaattcngggcctccagcctagacggacatcctcactactactcnctccctagtatatcgcaagaactaattacgttcgttcggtcggtcggtaacggacggacgtacgttacgtacgtcgttacgttcgacgaaccgacgcgtccgtcccgttccgtcgttcgtccg

SEQ ID NO: 316347 - DNA, 671 bp, Homo sapiens
  misc_feature: GZ8MTXP01EQNP9.51.19.B08.1.454.CMB.2.raw
  modified_base (317)..(317): a, c, t, g, unknown or other
  misc_feature (317)..(317): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtcgtgggtctcctggacagtccatcacctatctcatgcacgtcggaaccagccgtagtattagttgggtacttatctaccttgtcctcctaggtaaccaacaaccacccaaggaccaaaccgccccaaagtctattattagngacgaccaggtacggacgacgcctcgaggttatttcgtagtcgtccttctctcgtccctccgtcgtcgtcggaccaaaccgcccggtcccttaccgtacgtaacttagtttccgcgggtcctcgacgtccgtgggaacggacgtacgtcctacaacttactacgttcaccgttacctactaattacgacgtaacgaacgtaactaaacgtttcggttccggttggggttcggttcggggaacgggtaacgggttaaccgttaaggttcccgtaccggttaccggttacggttcttaacccggcccgtaacggtcccgtacccggtccccgttacggtcccttaacgttccccgg

SEQ ID NO: 316348 - DNA, 660 bp, Homo sapiens
  misc_feature: GZ8MTXP01CU4Y3.51.19.B08.1.454.CMB.2.raw
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcacgtacggaaccngtccgtgtatagttgggtacttatctaccttgtctcctgtaaccaacaacaccaggacaaacgaccccaagtctattattangacgccaagtagcgacgtctaggtaggtactttcgagttcgtccttcctcgtcgtccctccggacgtcgtcggaccgaccggcccggtccctcccgtagtactaactttccggtcgggaccttccgacggtacccgttagggaacggtaccgggtacgttacctaccgttaaccttacgtaaccgttccgtacccgttccctaacttagtactacggaaccaacggtactaaacgtttcggtttccggtagggttcggtacgggcgggtaacggttacgtaacggttcgtaaccgtcgttaacgttccgacgtaaccgacgtcccgtccgtcccgttcgtccttaacgttcccg

SEQ ID NO: 316349 - DNA, 553 bp, Homo sapiens
  misc_feature: GZ8MTXP01BVK6E.51.19.B08.1.454.CMB.2.raw
  modified_base (295)..(295): a, c, t, g, unknown or other
  misc_feature (295)..(295): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattattgggacttatctaccttgtctctgtaccaacacaccagacaaacgaccccaagtcattattangagcagtaggcgagcctagaggtatttcgtagtcgccttctctcgcctcgctctggcaacgccggccctccgtgactactttcgcggcctacgacgccgtgacggctagtctacactacgtatcgtcttctcgaatctcgacagtactaagttcgttccgttaggtcgttcgggaacgggtacggttaccgtaaggttcgacccgttcgacgttcacggtcccaggtcctccgtccccgttagtcccttccgttcccg

SEQ ID NO: 316350 - DNA, 657 bp, Homo sapiens
  misc_feature: GZ8MTXP01EUVKM.51.19.B08.1.454.CMB.2.raw
  modified_base (221)..(221): a, c, t, g, unknown or other
  misc_feature (221)..(221): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccngccgtgattagttgggacttatctaccttgtctcctagaccaacaacaccaggacaaacgaccccaagtcattattatgagccaggtacggcgacgcctacgaggtacttcgtagtcgtccttctcgtcgccctccgtcgtcgtcggacctaaaccgccgggtcccctccgtacgtaaccttaaacgttttccgtcggggtaccctcccgaacgtccgtagggaacgggtacggtactcctactactacctactcgccttctactaatacgtcgacaacgtaactaaagtttcggtttccgtcgggttcggttccggggaacgggtaacgggttaaccgtaacgggttcggacccggttacgttaacgggttccgaaccggtccccggtaaggtcccgttacccggcccccgttcggtaacccttccgtttccccg

SEQ ID NO: 316351 - DNA, 668 bp, Homo sapiens
  misc_feature: GZ8MTXP01BQ9UH.51.19.B08.1.454.CMB.2.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (305)..(305): a, c, t, g, unknown or other
  misc_feature (305)..(305): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctcgcctccgtgtcgtgggtctcctggacagtccatcacatctnatgcacgtacgaaccngccgtagattagttggtactttatctaccttgtctctacgaaccaacacaccagacaaacgaccccaagtactattattangacgcgagtaggcgacgcgtacgtaggttactttcgtacgtcgtcccttctcgtccgtcccgtccgtccgttaccgtcgggaccaaacccgtacccgggtccccttccccgttaagtaaccgttaactttccgggtcggacccttacgaccgtcgtacggaacggaacgtcgtaccgtacctactaactctcgtcctactcgtataacgtgaacctaaggtaattaaacgtttcggttaccgttggtccgggttcgggaacgggtaacggttacgtaacggttcgtaaaccgttccgttaacggttacccaaccgaacggtccgtaacccgtcccgtcgttacccgtaaccttccgtttcccc

SEQ ID NO: 316352 - DNA, 685 bp, Homo sapiens
  misc_feature: GZ8MTXP01B1ZB2.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctggcccagtctgccctgactcagcctgcctccgtgtcgtgggtctccgtggacagtccatcaccatctcatcgcacgtacggaaccagccgtagtattagttgggtaacttactctaccttcgtcctccgtacgtaaccaaacaaccacccgaaggaaccaaaaccgaccccctaaaagttcctaatttattacgtaggacggaccgtaggtacggcgacgtccgtagtaggtactttcgtacgtcgtcccttctctcgtccctccgacgtcgtcgaccaaaccgtccggtccctaccgtacgtaacttacgtttcgtcggcctaccgacgtccgtagggaacggtactcgttctaacctacttaccgtactccgtacctcctataactgtacgacgtacgtaacgttaacgtttcgtttccggttgggttcggttaccggggaacggaacggttaacgtacgttccgtacccgtacggttacgttccgacccgtaacgaccggtccctcccggtaccccgttcggtaacccttcgtttcccccgg

SEQ ID NO: 316353 - DNA, 641 bp, Homo sapiens
  misc_feature: GZ8MTXP01BXQ9X.51.19.B08.1.454.CMB.2.raw
  modified_base (242)..(242): a, c, t, g, unknown or other
  misc_feature (242)..(242): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggacttanctaccttgtctctgaccaacaacaccagacaaacgaccccaaagtcattattatgagccagtaggcgagcctcgagggtatttcgtagtcgtccttcctctcgtccctccgcgttctggaccaaaccgaccgggtcccctaccccgtagtacctaaacgttttcgcggggtccttaccgacgtccctaggacggtacgtagtccttcaaccttactactcgccttacctacacttatcgactaacgtaactaaagtttcgtttacgtggttcggttcgggaacgggtaacgggacctaaaggttccgaacccggttcgttacgggttccgaccggtaaccccgtaacggtcccgttccccgggtccccccgttagggttccccttaacccgtttccccg

SEQ ID NO: 316354 - DNA, 702 bp, Homo sapiens
  misc_feature: GZ8MTXP01B69IU.51.19.B08.1.454.CMB.2.raw
  modified_base (333)..(333): a, c, t, g, unknown or other
  misc_feature (333)..(333): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatccgtgggcccagtctgccctgactcagcctgcctccgtgtctggtctcctggacagtccatcaccatctcatcgcactacggaaccacgtccgtagtaattagttcgggtaacttactctaccttcgtctaccgtacggtaaccaaacaaccaacccaggaaccaaaccgacccccaaagtactaactttagtttanaggacgccgaagtacgggacgtacgcctacgtagggttatttacgtacgtccgtcccttcgttctccgtccctccgcgttccgtcgggaccaaccgtacccggtccctacccgtacgtaacttacgtttcgacggggtcctccggaacgtccgtagggacgtacgtaacgtcctacaactcgttactctacgtctagtactacgtacacgtaacgtaaccttaaagttccgtttacggtggttcgggttaccgggaacgggtaacgggaacgttaacgggttccgtaaccgttccgttacggttccgaaccgcccggtaaccggccgttccccggtaccccgttcggtaaccccttccgtttcccccgg

SEQ ID NO: 316355 - DNA, 602 bp, Homo sapiens
  misc_feature: GZ8MTXP01EAGDA.51.19.B08.1.454.CMB.2.raw
  modified_base (436)..(436): a, c, t, g, unknown or other
  misc_feature (436)..(436): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcgtggacagtccatccacatctcatcgcacgtaggaaacagccgtgtaattagttagggtactttagcctacttgtctccagtaaccaacaaccaccgaggacaaaacgaccccaaagtctaaattatttacaggacgtaccaggtaggcacgtcctaggaggttaatttcgtagtccgtccttcgtctgtcccgtacgcgtctcgggactaacgaccgtcctccgtacgacttacttcgtggcctacgacnccgtagaaacgggctacgtcacacttaacgtctctcctacntaacttcgganacacgtactacgttacgttcgtcggtcggtcggtaacggtacggttacgtacgttacgtacgtacgttacgcgacgaacgacgtccgtccgtccgttaccgtccgttccgtccg

SEQ ID NO: 316356 - DNA, 651 bp, Homo sapiens
  misc_feature: GZ8MTXP01D1I7X.51.19.B08.1.454.CMB.2.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (490)..(490): a, c, t, g, unknown or other
  misc_feature (490)..(490): n is a, c, g, or t
  modified_base (641)..(641): a, c, t, g, unknown or other
  misc_feature (641)..(641): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatccgtgggcccagtctcgccctgactcagcctgcctcgtgtcgtggtctcgtggacngtccatcaccatctcatcgcacgtcggaaccngccgtagtatagttaggacttatctacttgtctccgtacgaaccaaacaaccaccgaagaccgaaaccacccgaaatctattattagngacgacagtcggacgcgacgtagtaggtactttcgngtcgtccttctctcgccctcgtaacgctcggacaacgacccgtccctaccgtacgtaacttacgtttcgcggtacctccgaggtcctaggaacggtacgtactcctactaacctacgtactcctcgttaccctataatacngtaaccgagttaaccttaaagttccgggttagtcggtttaccgggcgggaacggtaaaggttaacccgtaaggtttcccggaaccgttacggttacgggttccaacccgggcccgtaacgtcccggtaaccctccccggttagtaaccccngttttccccg

SEQ ID NO: 316357 - DNA, 638 bp, Homo sapiens
  misc_feature: GZ8MTXP01AWTCZ.51.19.B08.1.454.CMB.2.raw
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctnatgcacgtacggaaccagccgtagtattagttgggacttatctaccttgtctcctggtaaccaacaaccacccaggacaaacgacccccaaagtctattatttanaggagaccagtaggcgagcctagaggtatttcgtagtcgtccttctctcgccctccggctccgtgaccaaacgcccgggtccctccccgtatactaacgtttccgtcgggtcctaccgtcggacccgttaggaacggtaccgtacgttacctaccgtacttacctactaccgtacctccctactaagtactgacgaacgtaactaagtttcgttccgttaggtcggttcgggaacgggtaacggaccgtaagttccgtaccgtcgttacgttccgttacgaaccccgtagcccgtaccggtcccccgttcggtccttccgttccccg

SEQ ID NO: 316358 - DNA, 504 bp, Homo sapiens
  misc_feature: GZ8MTXP02JBHNB.51.19.B08.1.454.CMB.2.raw
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcatatttatgagccagtaggcgagcctcagggatttcagtcgccttctctgcctcgcgtctggcaacacggcctccctgacaatttctgggctccagcctgaggacgagtctcactactactgctcctcatatgcagacaatagtttcctggtgttcggcggagggaccaaagttgaccgtcctaggtcagcccgaaggctcgcccctcggtcacttcc

SEQ ID NO: 316359 - DNA, 502 bp, Homo sapiens
  misc_feature: GZ8MTXP02GZNQR.51.19.B08.1.454.CMB.2.raw
  modified_base (375)..(375): a, c, t, g, unknown or other
  misc_feature (375)..(375): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcattatttatgaggccagtaggcgagcctcagggatttctagtcgccttctctgcctccgcgtctggcaacacggcctccctgacatttcnggctccagcctgaggacgagtctcactactactgctctcatatgcagacaatagttcctggtgttcggcgagggaccaaggttcgaccgtctaggtcagcccaaggctcgccccctggtccactccg

SEQ ID NO: 316360 - DNA, 502 bp, Homo sapiens
  misc_feature: GZ8MTXP02FN78I.51.19.B08.1.454.CMB.2.raw
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccagcaaagccccaaagtcatattatgagccagtaggcgagcctcagggatttctagtcgccttctctgcctcgcgtctggcaacacggcctcccngacaatttctggctccagcctgagacgagtctcactactactgctctcatatgcagacaatagttccnggtgttcggcgagggaccaagttcgaccgtctaggtcagcccgaaggcctacgccccctacggtccacgtcc

SEQ ID NO: 316361 - DNA, 604 bp, Homo sapiens
  misc_feature: GZ8MTXP02I7M4A.51.19.B08.1.454.CMB.2.raw
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatagttgggacttatcaccttgtctcctgtaccaacaacacccagacaaacgaccccaaagtcattattangagccagtaggcgagcctcgaggtntttcgtagtcgtccttctctcgtccctccgcgtctcggaccaaccgaccggccctacccgtactaacgtttccgtcgggcctcccgacgtcccgtaggaacggtaccgtacgtcctactaaccttacctacgttcgcccttcctactattactcgacaacgaacttaagttcgtttccgtgggttacggtacgggacgggtaacggtactaaggttcgaaaccgttcgtacgtccgacgacccgaaggtccctccgtcccccgtgtcctaccgtcttaccccg

SEQ ID NO: 316362 - DNA, 513 bp, Homo sapiens
  misc_feature: GZ8MTXP02F2GYI.51.19.B08.1.454.CMB.2.raw
  modified_base (376)..(376): a, c, t, g, unknown or other
  misc_feature (376)..(376): n is a, c, g, or t
  modified_base (416)..(416): a, c, t, g, unknown or other
  misc_feature (416)..(416): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattggggacttatcaccttgtctcctggtaccaacaacacccaggcaaagcccccaaagtcattatttatgaggccagtaggcgagcctcagggatttctagtcgcttctctgcctcgcgtctggcaacacggcctccctgacaatttcnggctccagcctgaggacagtctcactactaactgctcctnactatgccagactaatagtttcctggtgttcggcggagggaccaaagttcgaccgtctaggtcacgcccgaaaggctcgcccctcggtccacttccg

SEQ ID NO: 316363 - DNA, 504 bp, Homo sapiens
  misc_feature: GZ8MTXP02FLWLF.51.19.B08.1.454.CMB.2.raw
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggtatttctagtcgcttctctgcctcgcgtctggcaacacggcctcctgacatttcnggctcagcctgagacagtctcactactactgctcctnatatgcagacaatagttcctggtgttcggcggagggacccaaaggttcgaccgtcgtagtcagcccgaagctcgcccctcggtcacttccg

SEQ ID NO: 316364 - DNA, 502 bp, Homo sapiens
  misc_feature: GZ8MTXP02HCQQZ.51.19.B08.1.454.CMB.2.raw
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcaccttgtctctggtaccaacaacacccagcaaagccccaaagtcattattatgagccagtaggcgagcctcagggatttctagtcgccttctctgcctcgcgtctggcaacacggccctcctgacaatttcnggctccagcctgagcgagtcncactactactgcctcctcatatgccagacaatagtttcctgtgttcggacggaggggcctaaaggttgaccgtctaggtcagcccaaggcctcgcccctcggtccactccg

SEQ ID NO: 316365 - DNA, 494 bp, Homo sapiens
  misc_feature: GZ8MTXP02ID0SA.51.19.B08.1.454.CMB.2.raw
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcattatttatgagccagtaggcgagcctcagggatttctagtcgccttctctgcctcgcgtctgcaacacggcctccctgacaattcnggctccagcctgagacgagtcncactacactgctctcatatcgnagacaatagttccngtgttcggcggaggccaagttgaccgtcctagtcagcccgaagctacgcccctcggtcactccg

SEQ ID NO: 316366 - DNA, 510 bp, Homo sapiens
  misc_feature: GZ8MTXP02IP2DZ.51.19.B08.1.454.CMB.2.raw
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctgtaccaacaacacccaggcaaagccccaaagtcattatttatgaggccagtagcgagcctcagggatttctagtcgccttctctcgcctccgcgtctggcaacacggcctccctgacaattctggctccagcctgagacgagtctcactactactnctctcattangcaanactatagttcgtgtgtcggcggacggacgtacgtacgtacgtacgtacgtacgacgaaccgacgacgtcgcccgtccgtctactcg

SEQ ID NO: 316367 - DNA, 510 bp, Homo sapiens
  misc_feature: GZ8MTXP02ID21C.51.19.B08.1.454.CMB.2.raw
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcattatttatgaggccagtaggcgagcctcagggatttcagtcgcttctctgcctcgcgtctggcaacacggcctccctgacaatttcngggctccagccctgaggacgagtctcactacactgctcctcatatgcagacaatagtttccngggtnttcggcggaggaccaaagttcgaccgtcctaggtcagccccgaaggctcggccccctcggtacacttcc

SEQ ID NO: 316368 - DNA, 503 bp, Homo sapiens
  misc_feature: GZ8MTXP02HL39O.51.19.B08.1.454.CMB.2.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (415)..(417): a, c, t, g, unknown or other
  misc_feature (415)..(417): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagcctgatattgggacttatcaccttgtctctgtaccaacaacaccaggcaaagccccaaaagtcatattatgagcagtaggcagcctcagggatttctagtcgccttctctgcctcgccgtctgggcaaacacggcctccctgacaaatttctggctcagcctgaggaccagtctcactactactcncctctnatannnananaatacttctgtgtcggtcggacggacgtaacgtacgacgtacgtacgtcgacgaaccgacgacgtcgcccgtccgtctactc

SEQ ID NO: 316369 - DNA, 505 bp, Homo sapiens
  misc_feature: GZ8MTXP02F1E68.51.19.B08.1.454.CMB.2.raw
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacacaccaggcaaacgccccaaagtcatatttatgagccagtaggcgagcctcagggattctagtcgcttctctgcctcgcgtctggcaacacggcctcctgacaatttcngggctccgagcctgaggacgagtctcactactactgctcctnactatgcanactaattacgtttctggtgttcggacggtaggacctagttcgacgtcgtacgtcacgccgaagctcgcccctcggtcacgtcc

SEQ ID NO: 316370 - DNA, 500 bp, Homo sapiens
  misc_feature: GZ8MTXP02HWF2X.51.19.B08.1.454.CMB.2.raw
  modified_base (432)..(432): a, c, t, g, unknown or other
  misc_feature (432)..(432): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcattatttatgagccagtaggcgagctcagggatttcagtcgccttctctgcctcgcgtctggcaacacggcctccctgacaatttctggctccagcctgagacgagtctcactactactgctctcatatgcagacaatagtttccnggtgttcggcggtaggaccaagttcgaccgtctagtccagcccgaaggctcgcccctcggtcactccg

SEQ ID NO: 316371 - DNA, 509 bp, Homo sapiens
  misc_feature: GZ8MTXP02IIRGT.51.19.B08.1.454.CMB.2.raw
  modified_base (315)..(315): a, c, t, g, unknown or other
  misc_feature (315)..(315): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattatttatgagccagtaggcgagcctnagggatttctagtcgcttctctgcctcgcgtctggcaacacggcctcctgactaatttctgggcctccagcctgaggacgagtctcactactactgctcctcatatgcagacaatagttcctggtgttcggcggaggaccaagttcgaccgtcctacggtcacgcccgaaggctcgccccctcggtccactccg

SEQ ID NO: 316372 - DNA, 509 bp, Homo sapiens
  misc_feature: GZ8MTXP02IH74T.51.19.B08.1.454.CMB.2.raw
  modified_base (376)..(376): a, c, t, g, unknown or other
  misc_feature (376)..(376): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctccatgcactggaaccagccgtgatattgggacttatcaccttgtctcctggtaccaacaacacccaggcaaagcccccaaagtcatatttatgaggccagtaggcgagcctcagggatttctagtcgcttctctgcctcgcgtctggcaacacggcctccctgacaatttcnggctccagcctgagcgagtctcactactactgctcctcactatgccagacaattagtttcctggtgttcggcggtaggaccaagttgaccgtcctaggtcagcccaacggctcgcccccgtcggtccacttcg

SEQ ID NO: 316373 - DNA, 596 bp, Homo sapiens
  misc_feature: GZ8MTXP02HIA5Z.51.19.B08.1.454.CMB.2.raw
  modified_base (313)..(313): a, c, t, g, unknown or other
  misc_feature (313)..(313): n is a, c, g, or t
  modified_base (424)..(424): a, c, t, g, unknown or other
  misc_feature (424)..(424): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacaccaggcaaacgccccaaagtcattattatgagcagtaggcgagcctnagggtatttctagtcgccttctctcgcctccgcgttctggcaacacggcctcctgactattcgtggcctcgagccctgacgacgagtctacactactactcgtactcctanatatgaccagtaactaagttacgtttccgtgggttcgttacggggacgggaacgggtaccgtaaacggtttcggaccccgttaccgttaacgggttccgaaaccggccccggtaaacgggtccccttcccgggtacccccccgttcgggttacccctacccgttttccccgg

SEQ ID NO: 316374 - DNA, 556 bp, Homo sapiens
  misc_feature: GZ8MTXP02GLLTA.51.19.B08.1.454.CMB.2.raw
  modified_base (377)..(377): a, c, t, g, unknown or other
  misc_feature (377)..(377): n is a, c, g, or t
  modified_base (417)..(417): a, c, t, g, unknown or other
  misc_feature (417)..(417): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctgtaccaacaacacccaggcaaagcccccaaagtcattattatgagccagtaggcgagcctgagggtatttctagtcgccttctctgcctccgcgtctggcaacaccggcctcctgactatttcngggctccagcctgaggacagtctcactactactgctcctnatatgaccagactaattacgtttccgtggttcgttcggacgggtacgggaacctaacggtttcggaacccgttcccgtaacgggttccaacggaacccgtaaacgggcctccggcccccgtcggtccctactttccccg

SEQ ID NO: 316375 - DNA, 535 bp, Homo sapiens
  misc_feature: GZ8MTXP02GYPCW.51.19.B08.1.454.CMB.2.raw
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcattatttatgagccagtaggcgagcctnagggatttcagtcgccttctctgcctccgcgtctggcacacggcctccctgacaatttcngggctccagcctgaggacagtctcactactactgacctcctcatatgacagactaatacgtttcctaggttgttccggcggtacgggaccctaaaggttcggacccgtcgtaacggtccacggcccaaggtcctcggccccctacggtccaacgtttcccg

SEQ ID NO: 316376 - DNA, 519 bp, Homo sapiens
  misc_feature: GZ8MTXP02JLP1L.51.19.B08.1.454.CMB.2.raw
  modified_base (366)..(366): a, c, t, g, unknown or other
  misc_feature (366)..(366): n is a, c, g, or t
  modified_base (411)..(411): a, c, t, g, unknown or other
  misc_feature (411)..(411): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctctgtacaacacaccagcaaacgccccaagtcattattatgagcagtagcgagcctcaggtatttctagtcgtccttctctgcctcgcgtctggcacaccggcctcctgactaatttcnggcctccagccgtgaggacgacgtctacactactactcgctcctnactatgacagactaaattcgtttccaggttcgtcggacggtacggaccgtaaaggttcgacccgtcgtaaggtccagcccaaggcctcgcccctcggtccacgttccc

SEQ ID NO: 316377 - DNA, 547 bp, Homo sapiens
  misc_feature: GZ8MTXP02G1KWQ.51.19.B08.1.454.CMB.2.raw
  modified_base (379)..(379): a, c, t, g, unknown or other
  misc_feature (379)..(379): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattatttatgagccagtaggcgagcctgagggtatttctagtcgccttctctcgcctcgcgtctggcaacacggcctcctgactaatttcnggcctccagcctgagacgagtcctacactacgtactcgtacctcctcatatcgacagacctaagttacgtttccgtgggtacgttcgggacggacgggacctaaaggttcgacccgtcgtacggtccacgcccgaaggtcctacgccccctacggtccacgtttcccg

SEQ ID NO: 316378 - DNA, 583 bp, Homo sapiens
  misc_feature: GZ8MTXP02JPO21.51.19.B08.1.454.CMB.2.raw
  modified_base (301)..(301): a, c, t, g, unknown or other
  misc_feature (301)..(301): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggacttatctaccttgtctcctggtaccaacaacacccaggacaaacgccccaaagtcattattangagccagtaggcgagcctagagggtactttctagtcgtccttctctcgcctcgcgtctcggccaaacgccggccctccctagacctaagtttccgcgggtcctcccgagtccctaggacggaccgagttccacactactactcgtcctcctacattacgtcgacaagtactaagtttacgtttccgtagggtcgttcgggacgggaacggacctaaggttcgaccgttaccgtacggtacacgtcccgaacgccgtccgacccccttggcctacgtttcccg

SEQ ID NO: 316379 - DNA, 566 bp, Homo sapiens
  misc_feature: GZ8MTXP02IF3W0.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatcacttgtctctggtaccaacaacaccagacaaacgccccaagtcatattatgagcagtaggcgagcctgagggatttctagtcgccttctctcgcctccgcgtctgggcaacgaccggtcctccccgtgactaactttcgtggcctccgagccctagaggacgagtctcactactactcgcctctcatatgacagactaattcgtttccgtaggttgttacgggacgggaacgggacctaaacggttcggaacccgttccgtaacgggttacacggtaaccccgaaaggtccgtcccgtcccccgtcggtaccacccgtttcccg

SEQ ID NO: 316380 - DNA, 501 bp, Homo sapiens
  misc_feature: GZ8MTXP02F5HTG.51.19.B08.1.454.CMB.2.raw
  modified_base (373)..(373): a, c, t, g, unknown or other
  misc_feature (373)..(373): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagccccaaagtcatattatgagccagtaggcgagcctcagggatttctagtcgccttctctgcctcgcgtctggcaacacggcctcctgacaatttcngggctccagcctgaggcgagtctcactactactgctcctcatatgcagacaatagttcctggtgttcggcggagggaccaagttcgaccgtcgtaggtcagcccaaggctcgcccctggccacttccg

SEQ ID NO: 316381 - DNA, 507 bp, Homo sapiens
  misc_feature: GZ8MTXP02HS7AG.51.19.B08.1.454.CMB.2.raw
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagcgatcgtatacacgaccggtgctcgatttagtgagtcagtaagggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctggtaccaaacacacccaggcaaagccccaaagtcattatttangaggccagtaggcgagcctcagggatttcagtcgcttctctgcctcgcgtctggcaacacggcctcctgactatttcngggcctcagcctgacggcgagtctcactactactgctctcattangcagactatacgtttcnggtgttcggcggtaggacctaagttcgaccgtcgtaggtcacgcccgaaggcctcgccccttacggctactccg

SEQ ID NO: 316382 - DNA, 523 bp, Homo sapiens
  misc_feature: GZ8MTXP02IB28G.51.19.B08.1.454.CMB.2.raw
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctggtaccaacaacacccagcaaagccccaaagtcattatttatgaggccagtaggcgagcctcagggatttctagtcgccttctctcgcctccgcgtctggccaaacacggccctccctgactaatttcnggctcagcctgagacgagtcncctactactactgtctcctcatatgacagacaagttacttccgtggtcgttcggcggacggaccgtaagttcgacccgtcgtacgtcacgcccgaaggcctcgccccgtcggctactcccg

SEQ ID NO: 316383 - DNA, 562 bp, Homo sapiens
  misc_feature: GZ8MTXP02IYV7G.51.19.B08.1.454.CMB.2.raw
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctggtaccaacacacccaggcaaacgccccaaagtcattatttangagccagtaggcgagcctcagggtatttcagtcgcttctctgcctcgcgtctggcaacncggccctcctgactattcgnggctccagcctgaggacgagtctcactactactgctcctnatatcgacagactaagttacgtttccgtagggttcgttacgggacgggtacggggtaacctaaacggtttcgaacccgttccgtaacggttccaacggccccgaaagggtcctacccggtcccccgttacgggtcctacctttcccgg

SEQ ID NO: 316384 - DNA, 548 bp, Homo sapiens
  misc_feature: GZ8MTXP02HKNUJ.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccagcaaacgccccaaagtcattattatgagccagtaggcgagcctcgagggatttctagtcgccttctctcgcctcgcgtctggcaacacggcctccctgactaattcgtggcctccagcctgacggacgagtctcactactactgcctcctcatatcgacagacaagttacgtttccgtggtcgttccgggacgggtacgggtaccctaaaggttcgaacccgttccgtaacggtcacgaacccgaacggccttcggccccctcggtcctacgttcccg

SEQ ID NO: 316385 - DNA, 503 bp, Homo sapiens
  misc_feature: GZ8MTXP02F8CUA.51.19.B08.1.454.CMB.2.raw
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccagcaaacgcccccaaagtcattattatgaggccagtaggcgagcctcaggattctagtcgccttctctgtcctcgcgtctggcaacacggcctcctgacaattcnggctcagcctgacgacgagtcncactactactgctctcatatgcagacaatacgttccagtgttcggcggaggtaccaagttcgaccgtcgtaggtcagcccgaagcctcgccccctcggtcacttcccg

SEQ ID NO: 316386 - DNA, 503 bp, Homo sapiens
  misc_feature: GZ8MTXP02GLZ23.51.19.B08.1.454.CMB.2.raw
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattggacttatcacttgtctctgtacaacaacaccagcaaagccccaaagtcattattatgagccagtaggcgagcctcaggattctagtcgcttcnctgcctcgcgtctggcaacacggcctcctgacaatttcnggctcagcctgagacgatctcactactactcnctctnatancacagtactaagttacgttcgtggtcgtcggacggtacggactacgtacgaccgtacgtacgtcacgaaccgacgccgtccgcccgtcgtacctactcg

SEQ ID NO: 316387 - DNA, 503 bp, Homo sapiens
  misc_feature: GZ8MTXP02HNIEX.51.19.B08.1.454.CMB.2.raw
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattatttatgaggccagtaggcgagcctcagggatttcagtcgccttctctgcctcgcgtctggcaaacaccggcctccctgacctaatttctggcctcagccctgaggacagtcncactactactgctcctcatatgcagacaattagtttccnggtgttcggcgaggaccaagttcgacgtcaggtcagcccgaagctcgcccctcgcactccg

SEQ ID NO: 316388 - DNA, 518 bp, Homo sapiens
  misc_feature: GZ8MTXP02FYLTE.51.19.B08.1.454.CMB.2.raw
  modified_base (376)..(376): a, c, t, g, unknown or other
  misc_feature (376)..(376): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcaccttgtctcctggtaccaacaacacccagcaaagccccaaagtcatatttatgagccagtaggcgagcctcagggatttctagtcgccttctctgcctcgcgtctggcaacacggccctccctgactaatttcgngggccttccgaagcccttaggaggacgagtctcactactactgctcctnatatgcagacatagtttccnggttgtcggacggtaggacctaaggttcgaaccgtctaggtcagcccaaggctcgcccctcggtccacttccg

SEQ ID NO: 316389 - DNA, 584 bp, Homo sapiens
  misc_feature: GZ8MTXP02HPD5K.51.19.B08.1.454.CMB.2.raw
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtcgtgggtctcctggacagtccatcaccatctcatgcactggaaccagccgtgattagttgggacttatctaccttgtctcctggtaccaacacacccaggacaaacgccccaaagtcattacttatagacggacctagtacggcgagcctcgagggtatttcgtagtcgtccttctctcgcctcgccgtctcgggacaaccgaccggtccccttacccgtacggacctaaactttcgtcggggtccttcccgaacggtcccttagggacggtaccgagttcctcactactactcgtcctcccttanatacncgacatactagttcgttcgtggtcgtcggacggacggtacgtacgtcgtaccgtcgtacgtacacgaaccgacgtccgtccgcccgtcgtctacgtcc

SEQ ID NO: 316390 - DNA, 632 bp, Homo sapiens
  misc_feature: GZ8MTXP02G872C.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttggacttatctaccttgtctcctcgtaaccaacaaccaccagaccaaacgaccccaaagtctattattatagacgaccaggtaggcgacgcctacgtaggtatttcgagtcgtccttctctcgtccctccgcgttctcgggaccaaccgaccggtccctcccgtagtactaacgtttcgacgggtccctccgaacgtccgtagacggacgacgtcctacactactactcacctctacatatcgacaacgtactaagtttacgtttccgtgggttacggttccgggtaacggggtaccggtaaaccttaacgggttacccggaaccggttccgtaacggtaccgaccggaacccgtaacggtcccgtcccggacccccgttccggtacctaccgtttccccg

SEQ ID NO: 316391 - DNA, 575 bp, Homo sapiens
  misc_feature: GZ8MTXP02GQZEI.51.19.B08.1.454.CMB.2.raw
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatatgggacttatcaccttgtctcctgtaccacaacacccaggcaaacgccccaaagtcattatttatgaggccagtaggcgagcctacagggatttctagtcgccttctctcgcctcgcgtctggcaacaccggcctcctgacaatttcgnggctcagcctgagcgagtcncactacgtactgcctcctacatactgacaagactaattacgtttcccgtggtgttaccgggacgggacggggtaccctaaaggttcggaacccggttaccgtacggggttaccaacggtaacccccgaaacggtcccttcgggacccccccgtttagggtccctaaccgtttccccg

SEQ ID NO: 316392 - DNA, 519 bp, Homo sapiens
  misc_feature: GZ8MTXP02IQWNZ.51.19.B08.1.454.CMB.2.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatatgggacttatcaccttgtctcctgtaccaacaacacccaggcaaagcccccaaagtcattatttatgaggccagtaggcgagcctcagggatttctagtcgcttctctgcctccgcgtctggcaaccacggcctccctgactaatttcnggctcagcctgaggcagtctcactactactgactcctcatntgcagacaattacgttcctggtcgttcggcggagggtacctaaggttcgaccgtcgtacggtcacgaacccgaaggcctcgccccgtcggtcacttcccg

SEQ ID NO: 316393 - DNA, 526 bp, Homo sapiens
  misc_feature: GZ8MTXP02HETLX.51.19.B08.1.454.CMB.2.raw
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (411)..(412): a, c, t, g, unknown or other
  misc_feature (411)..(412): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctgtaccaacaacaccagacaaacgccccaaagtcattattatgagccagtagcagcctcagggatttcagtcgccttctctcgcctcgctctggcaacgacgcctccngactaattcnggctcagctgagacagtcncactactactgcttcctnatgtnnagacaagttacgtttcctaggtcgttcggacgggacggaaccctaagttcggaccgttccgtacgtcacgaacccgaaggccttccggcccccttcgggtaccctacgttcccg

SEQ ID NO: 316394 - DNA, 591 bp, Homo sapiens
  misc_feature: GZ8MTXP02HS4XO.51.19.B08.1.454.CMB.2.raw
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattattgggacttatcaccttgtctcctggtaccaacaacacccaggacaaacgccccaaagtcaattatttatgaggccagtaggcagctcgaggtatttctagtcgccttctcctgcctcgcgtctcggcaaacnccgccctcctgactattcnggctcagcctgaggcagtctcactactactcgaccttccctnaacgtactacgacaacgtaactaaacgtttagtttcccgtggggttacgttccgggacggggaacgggttaccgtaaacggttcggtaaccccgtacgttacggtacccacggtaaccccaacgggaccttcccggacccccgttcggtaccctaccgtttccccgg

SEQ ID NO: 316395 - DNA, 577 bp, Homo sapiens
  misc_feature: GZ8MTXP02G5731.51.19.B08.1.454.CMB.2.raw
  modified_base (292)..(292): a, c, t, g, unknown or other
  misc_feature (292)..(292): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcaccttgtctctgtaccaacaacaccagcaaacgccccaaagtcattatttangagccagtaggcgagcctcagggtatttcagtcgccttctctgcctccgcgttctcgggcaacgaccggtccctccctagactactttcgcgggtcctccacgtccctagacggaccgagttcctcactactactgtcctccttcattatcgaccaagaactaagttacgtttcccgttgggtacgttccgggacgggtaacggaccgtaaagtttcggacccgttcgtaacggtccgacgaacccgaagggtccctccggccccctcggtcctacgtttccccg

SEQ ID NO: 316396 - DNA, 603 bp, Homo sapiens
  misc_feature: GZ8MTXP02GWQ88.51.19.B08.1.454.CMB.2.raw
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcactgtctctgtacaacacaccagacaacgccccaaagtcatattatgagcagtaggcgagcctcgagggatttcgtagtcgccttctctcgtcctccgcgtctcggcaaacgaccggcctccctagactaatttcgnggcctccagcctgaggacgtagtctcacttactacgtncctcctctatactgacagtaactaacgtttacgtttccgtggggtttcgttacggggaccgggtaaaggggtaacccgtaaacggtttccggaacccgttaccggtaacggttccgaacggaaccccgtaaaacgggtccgttcccggtaaccccccgttcgggttacccctaccggtttcccccg

SEQ ID NO: 316397 - DNA, 512 bp, Homo sapiens
  misc_feature: GZ8MTXP02F0BUV.51.19.B08.1.454.CMB.2.raw
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
tcagcgatcgtatacacgaccggtgctcgatttagtgagtcagtaagggggggttcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattattatgagccagtaggcgagcctcagggtatttctagtcgccttctctgcctcgcgtctggcaaacncggcctcctgacaatttcngggctcagcctgagacgagtctcactactactgctcctnatatgcagacaattagttcctggtgttcggcggagggaccaagttcgaccgtcctaggtcacgcccgaaggcctcgccccctggtccacttcccg

SEQ ID NO: 316398 - DNA, 523 bp, Homo sapiens
  misc_feature: GZ8MTXP02HNPTJ.51.19.B08.1.454.CMB.2.raw
  modified_base (288)..(288): a, c, t, g, unknown or other
  misc_feature (288)..(288): n is a, c, g, or t
  modified_base (364)..(364): a, c, t, g, unknown or other
  misc_feature (364)..(364): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattgggacttatcacttgtctctgtacaacacaccagcaaacgccccaaagtcattattangagcagtagcgagctcaggtatttcagtcgccttctctcgcctcgcgtctcggcaacacgccctcctgactattcnggcctcagctgagcgagtctcactactactgtacctcctacattatcgacaacgtaactaaattcgtttccgtggttgttccgggacggtacgggacctaaggttcgacccgtcgtaacggtcacgaaccgaggcctccgcccctcggcctacttcccg

SEQ ID NO: 316399 - DNA, 513 bp, Homo sapiens
  misc_feature: GZ8MTXP02JSHA5.51.19.B08.1.454.CMB.2.raw
  modified_base (417)..(417): a, c, t, g, unknown or other
  misc_feature (417)..(417): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggacaaacgccccaaagtcattatttatgaggccagtaggcgagcctcagggatttcagtcgccttctctcgcctccgcgtctggcaacacggcctcctgactaatttctgggcctccagccctgacggacgagtctcactactacngctctcatatgcagacaatcgttcctggtgttcggcggaggacctaagttcgacgtccaggtccagcccgaaggcctcgccccctggtccactccg

SEQ ID NO: 316400 - DNA, 538 bp, Homo sapiens
  misc_feature: GZ8MTXP02JNYOI.51.19.B08.1.454.CMB.2.raw
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatatgggacttatcacttgtctcctggtaccaacaacacccaggacaaagccccaaagtcattattatgaggccagtaggcgagcctgaggtatttcagtcnccgttctctgcctcgcgtctggcaacgaccggcctccctgacctaatttcgnggtacctcagcctgagacgngtcncactctactgtctctacatatgactagactaagttacgtttcctaggtcgttcggacggtacgggacctaaaggttcgaaccgttccgtacggtccacggcccgaagggcctccgcccctcggtccacttcccg

SEQ ID NO: 316401 - DNA, 608 bp, Homo sapiens
  misc_feature: GZ8MTXP02F85MX.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattattgggacttatcaccttgtctcctgtaccaacaacacccaggacaaacgccccaaagtctattattatgagccagtaggcgagcctcgagggtattctagtcgtccttctctcgcctccgcgtctcggcaacaccggtccctccctgactactttcgtggtcctccgacgcctggacggacgacgtctacactactactcgccttacctctattagtcgacctaagaacttaaagttacgtttcccgttgggttcggtttacgggacgggtacgggtaccgtaacggttccggtacccggttacccgtaacggttccgaaccggccccgtaaacggtcccgtcccggtcccccgtcgggtccctaaccgtttccccg

SEQ ID NO: 316402 - DNA, 527 bp, Homo sapiens
  misc_feature: GZ8MTXP02GFAWJ.51.19.B08.1.454.CMB.2.raw
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcacttgtctcctggtaccaacacacccaggcaaacgccccaaagtcattattangagccagtaggcgagcctcagggatttctagtcgccttctctcgcctccgcgttctggcaacacggcctccctgactaatttcnggctccagctgagacgagtctcactactactgctcctcatatcgacagactaagttacgtttcctggtcgttcggacggtacgggacctaggttacgaccgtccgtaggtccaggcccgtaaggcctcgcccccgtggtcctacttccg

SEQ ID NO: 316403 - DNA, 533 bp, Homo sapiens
  misc_feature: GZ8MTXP02HSH4I.51.19.B08.1.454.CMB.2.raw
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctggtaccaacaacacccaggcaaacgccccaaagtcattattatgagccagtaggcgagcctcaggatttctagtcgccttctctgcctcgcgtctggcaacacggcctcctgactatttcgnggctccagcctgaggcgagtcncactactactgtctcctnatatgacagactaaatcgtttccgngggttacgttcgggacggtaggggaccctaaaggttcgaccgttcgtacggtacacgccccgaaggcctcgcccccttcggtcctaccgttccg

SEQ ID NO: 316404 - DNA, 530 bp, Homo sapiens
  misc_feature: GZ8MTXP02JD4PY.51.19.B08.1.454.CMB.2.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
  modified_base (523)..(523): a, c, t, g, unknown or other
  misc_feature (523)..(523): n is a, c, g, or t
tcagcgatcgtatacacgaccggtgctcgatttagtgagtcagtaaggggggggtcgacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctctgtaccaacacacccagcaaacgccccaaagtcattattangagccagtagcgtancctnagggtatttctagtcgccttctctgccctcgcgtctggcaacaccggcctcctgacatttcgnggctcagcctgagacgagtctcactactactgtcctcctacgactatcgacgaataccaaagtttcgttcctggtcgttcgggacggagggaccctaggtccgacgtccgtaggtcaacgcccgaagtcgccgtaccccgtcgtacncgttccc

SEQ ID NO: 316405 - DNA, 641 bp, Homo sapiens
  misc_feature: GZ8MTXP02I846O.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatctaccttgtctcctggtaccaacaacacccaggacaaacgccccaaagtcacttatttatgaggccagtaggcgagcctcagggtatttctagtcgccttctctgcctccgcgttctcggccaacgaccggtccctccctgacctaagtttcgcggggtccttcccgagtcccttggacggaccgtaagtcctacacttactacgtcgtccttaccctcatacgttgacctaagacctaattacgttttccgtggttacggtttcgggacgggtacgggtaacccgtaaaggttccggtaacccgtttaccgttaacgggttaccgaaccggtaaccccggaaacggttccccgttccggacccccccgtttcgggttacccctaaccggttttcccccg

SEQ ID NO: 316406 - DNA, 620 bp, Homo sapiens
  misc_feature: GZ8MTXP02H9YCV.51.19.B08.1.454.CMB.2.raw
  modified_base (294)..(294): a, c, t, g, unknown or other
  misc_feature (294)..(294): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattagttgggacttatctacttgtctctgtaccaacacaccaggacaacgccccaagtcattattangacgacagtagcgagtcctagaggtatttactagtcgtccttctcctcgcctcgcgtctcggcaacgaccgtccctccctgactatttccgacggcctccgagtcctggacggtacgtcgtcctaccaccgtacttacctcgtcccttccctactatttacacgacgtaacgtaacttaagtttaccggttttccgtgggtttcgggttaccggggcgggtaaccgggtaaccgttaaacggttccggaaaccgttcccgtaggttacccacggtaaccccgaggtccctacccggtcccccgtcggtaccctaccgtttccccgg

SEQ ID NO: 316407 - DNA, 583 bp, Homo sapiens
  misc_feature: GZ8MTXP02FRZBV.51.19.B08.1.454.CMB.2.raw
  modified_base (433)..(433): a, c, t, g, unknown or other
  misc_feature (433)..(433): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgcccccaaagtcattattatgaggccagtaggcgagcctcgagggatttctagtcgccttctctgcctccgcgtctcggcaacacggcctccctgactaatttcgtgggacctccacgccctgacggacgagtctcactactactcgcctccctnattatgcaagactaaatttacgtttccgtgggttacggttcgggcgggtaacgggacctaaaggttcggaacccggttccgtaacgggttccacggaacccccgaaagggtcccgtccggtccccccgtcggtaccctaccgtttccccg

SEQ ID NO: 316408 - DNA, 581 bp, Homo sapiens
  misc_feature: GZ8MTXP02ISORW.51.19.B08.1.454.CMB.2.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
tcagcgatcgtatacacgaccggtgctcgatttagtgagtcagtaaggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatagttggacttntcaccttgtcctcctggtaccaacaacacccaggacaaacgccccaaagtcacttatttangaggccagtaggcgacgcctcgagggtatttcagtcgaccgttctctcgcctccgcgtctggacaaacaccggcctcccgtagactaacttttcgcgggtctcccgagcccgttgacgtcgacgtctcgactatacncgtctccctnactntcgacagaactaagtacgtttcccgnggttacgttcgacggtaaggtacctaggttaccgtaccgtccgtaggtaccacggtaaccccgtaagggtcttcccgggaccccctcggtacctaaccgtttcccg

SEQ ID NO: 316409 - DNA, 524 bp, Homo sapiens
  misc_feature: GZ8MTXP02GD60P.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccagcaaacgcccccaaagtcattattatgagccagtaggcgagcctcgagggtatttctagtcgcctttctctgcctccgcgttctggcaacacggcctcctgacatttctgggcctcagcctgaggacgagtctcactactactgctcctcatatcgacagacaattagtttcctggtgttcggcggtacggacctaaagttcgaccgtcgtacggtcacgcccgaaggcctacgccccctggtccactttccg

SEQ ID NO: 316410 - DNA, 642 bp, Homo sapiens
  misc_feature: GZ8MTXP02FU4Z0.51.19.B08.1.454.CMB.2.raw
  modified_base (293)..(293): a, c, t, g, unknown or other
  misc_feature (293)..(293): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcacatctcatgcactggaaccagccgtgatagttgggacttatctacttgtctctgtaccaacaacaccagacaaacgccccaaagtcattattangagcagtaggcgagcctagaggtattctagtcgtcccttctctcgtccctcgacgttctcggaccaaccgaccggtccctaccctaggtaacctaaacttttccgcggggtcccttacccgaacggtcccgttaggaacggacgtaacgttcctaccgtaaacctaccttaacctcgtccttaccctatacgttatacgactaacgtaacttaagtttacgttccgtggttcggtacggggacgggtaacggtaaccgtaacgttaccggtaccgttaccgtacggtacccgaaccgtaacccgtaacggccctaccccggtacccccgttacggtaccctaccgtccg

SEQ ID NO: 316411 - DNA, 559 bp, Homo sapiens
  misc_feature: GZ8MTXP02IF53G.51.19.B08.1.454.CMB.2.raw
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgattattgggacttatcacttgtctctggtaaccaacaacacccaggacaaacgccccaaagtcattatttatgaggccagtaggcgagcctcgagggtatttctagtcgctttcctctcgcctcgtcgtctggcaacaccggccctcctgactaactttcgnggctaccacgcctagacggtaccgagtcctcactacgtactcgcctccttanatagcacgaatactacgttacgttcgttcggtcggtcggtcggacggtacgtacgtacgtaccgtacgtacgtacgacgaaccgtacgtaccgtccgtcccgtccgtccgtacgtccg

SEQ ID NO: 316412 - DNA, 531 bp, Homo sapiens
  misc_feature: GZ8MTXP02HLR7L.51.19.B08.1.454.CMB.2.raw
  modified_base (292)..(292): a, c, t, g, unknown or other
  misc_feature (292)..(292): n is a, c, g, or t
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtagatagttgggacttatcacttgtctctgtacaacacaccagacaaacgccccaaatcattatttangagcagtaggcagcacaggtatttcgagtcgcttcgtctcgcctcgcgtctggacaacgaccggccctccctgactaatttcgnggcctcagcctagacgacgatctacactactactcnctcttacattagcacacgataaacgtgtttcgtggtgttccggaggtacggaccaagttcgaaccgtccgttaaggcacgaaccgaaggcttcccggccccttcggaccttacttcccg

SEQ ID NO: 316413 - DNA, 577 bp, Homo sapiens
  misc_feature: GZ8MTXP02FK97Q.51.19.B08.1.454.CMB.2.raw
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattattatgagccagtaggcgagcctcagggatttcgtagtcgcctttctctgcctccgcgttctggcaacacggccctccctgactaatttctggctccagcctgagacgagtctcactactactgctcctcactatgaccagacaagttacgtttccgtggttcgttcgggacgggtaacggggaaccgtaaacggtttcggaacccgtttccgtaacggttcccgaacggccccgtaaaagggcccttaccggtccccccgttcgggttacccaccgtttccccgg

SEQ ID NO: 316414 - DNA, 615 bp, Homo sapiens
  misc_feature: GZ8MTXP02IGVWU.51.19.B08.1.454.CMB.2.raw
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
  modified_base (447)..(447): a, c, t, g, unknown or other
  misc_feature (447)..(447): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagcctgattattgggacttatctaccttgtctcctcggtaccaacaacacccaggacaaacgaccccaaagtcattatttatgagaccaggtagcgagcctnagggtattctagtcgtccttctctcgcctcgcgtctcggaccaacaccggccctccctagactactttcgnggcctccgacgccctagacggacgtactctctacctactacgtctacctccctntatactagaccagtaacctaagtttcgtttccgtgggttcggtccgggtacgggaacgggtacccgtaaacggtttcccggaaacccggttccgtaacgggttcccaacggaaccccgttaaacggcccgtcccgtcccccgtaccgggttccaccccgtttccccgg

SEQ ID NO: 316415 - DNA, 602 bp, Homo sapiens
  misc_feature: GZ8MTXP02IRASV.51.19.B08.1.454.CMB.2.raw
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctcgtgtcgtgggtctcctggacagtccatccacatctnatgcacgtggaaccagccgtanattagttggacttatctaccttgtctcctcggtaaccaacaaccaccagaccaaacgccccaaagtctattattagagacgacaggtacggcgagcctagaggtactttcacgtcgtccttctctcgtcctccgcgttctcggacaaccnccgtccctcctacgacttacgtttcgnggtaccctccgagtcccgtaaggacggtacgtcgtccacaccttaacgtctcgtcctccttacgaattcgtagaccaagtaactaaggttcgtttccgtagggtccgtacgggtacggaacgggtactaacgggttccaccgttcgtaacgccacggtaacccgtaggcctcccggaccctcggtactcgttcccg

SEQ ID NO: 316416 - DNA, 691 bp, Homo sapiens
  misc_feature: GZ8MTXP02IHGMN.51.19.B08.1.454.CMB.2.raw
  modified_base (222)..(222): a, c, t, g, unknown or other
  misc_feature (222)..(222): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctctggacagtccatcaccatctcatgcacgtcggaaccngccgtgatagttggacttatctacttgtctctagtaaccaacaacaccagacaaacgaccccaagtcattattangagcagtagcgagcctgaggtattcgtagtcgtcttcnctcgtcctcgcgttctcggacaaccgaccggcccttaccctagaaccttaacgtttccgtcggggacccttacccgacggtacccgttaggaacggggtaaccgtacggttaccctacctaaacccttaacctaccgttcgtccctttacccttacaacgttacgtacgacctaaacggtaaacttaaagtttcgttttacccggtggggtttaccgggtttaccggggacggggtaaacggtaacccgttaaaggtttcccggtaacccgttaccggtaacggttaccgacccggtaaccccggaacggtccctaccccggtaccccccgtttacggacccttacgttcccccgg

SEQ ID NO: 316417 - DNA, 532 bp, Homo sapiens
  misc_feature: GZ8MTXP02I78RP.51.19.B08.1.454.CMB.2.raw
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (522)..(522): a, c, t, g, unknown or other
  misc_feature (522)..(522): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatccgtgggcccagtctgccctgactcagcctgcctccgtgtctggtctcctggacagtccatcaccatctcatgcactggaaccagccgtgattagttgggacttatctacttgtctctgtaccaacacaccagacaacgccccaancattattangagccagtaggcagcctgaggtatttcaggtctccttctctcgcctcgcgtctggacaacgccggtccctcctagactactttcgcggcctccagcctggagacgatctacactactacgntcctctnatgtagactagaacctatacgttcgtggtcgtacggacggacggactacggtcgtaccgtacgtacgtacgacgcccgaaggccgtccacccccgtgtaccnccgtttcccg

SEQ ID NO: 316418 - DNA, 817 bp, Homo sapiens
  misc_feature: GZ8MTXP02FJK36.51.19.B08.1.454.CMB.2.raw
  modified_base (298)..(298): a, c, t, g, unknown or other
  misc_feature (298)..(298): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatcaccttgtctcctgtaccaacaacacccagcaaacgacccccaaagtcattattangagccagtaggcgagcctgaggtatttcgtagtcgtcctttctctcgccctccgcgttctcgggaccaaacgaccgggtacccctcccgtaggaaccttaacgttttcgtcggggtccctttcccgacgtacccgttaggaacggggtaccggtaaacggttcccttacccgaaaacctttaacccttaaacccgttcggttaacccctttcccccgttattaaaacttcgttacgtaaccccgaaaggtaaacctttaaaaccgtttaacgggtttttacccccggtggggttttcggggttttaccccgggggaccgggggtaaaaccgggggttaaacccgttaaaaaccggggtttttcccgggaaaacccccgggttttccccgggtttaaaccgggttacccccggtaaaacgggaacccccccggtaaaaaggggttcccccgttacccccggggttaaccccccccggtttcccggggtttaaccccctaaacccggtttttcccccccgg

SEQ ID NO: 316419 - DNA, 558 bp, Homo sapiens
  misc_feature: GZ8MTXP02H2U3S.51.19.B08.1.454.CMB.2.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatcncatgcactggaaccagccgtgattagttgggacttatcaccttgtctctgtaccaacacaccagacaaacgccccaaagtcattattangagccagtaggcgagcctcgagggtatttcgtagtcgtccttctctcgccctccgcgttcgtcggcaaaccgccggtccctcccgtgactatttcgnggcctcgagccctggacggacgtacgtctcctactctactcgtcctccctntatatcgacagactattacgttcgtggtcgttacggcggacgggtactaaggttcgaaccgttcgtaacggtctacgcccgtaaggcccgtcgcccccgtcggtacacccttccg

SEQ ID NO: 316420 - DNA, 588 bp, Homo sapiens
  misc_feature: GZ8MTXP02FNC5U.51.19.B08.1.454.CMB.2.raw
  modified_base (241)..(241): a, c, t, g, unknown or other
  misc_feature (241)..(241): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcacgtggaaccagccgtgatagttggacttncaccttgtctctgtaccaacaacacccagacaaacgccccaaagtcattattatgagccagtacggcgagcctgaggtatttctagtcgccttctctgtcctccgcgttctcggacaacgaccggccctccctagacctaagtttcgtcgggtcccttccgacgcccgttaggacggaccgtagttacctacaaccttacttaccgtctaccttcctacattactcgacgagaactaagtttacgttccgtggtcggttccggacgggtaacggtacgtaaacgttcggaaccgtccgtaacggtcacgaaccgaacggtccttacgcccctaggtcctacttcccg

SEQ ID NO: 316421 - DNA, 692 bp, Homo sapiens
  misc_feature: GZ8MTXP02IWPDW.51.19.B08.1.454.CMB.2.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatctaccttgtctcctggtaaccaacaacacccaggaccaaacgcccccaaagtcattatttangacgccagtaggcgagcctnagggtatttcgtagtcgccttctctcgcctccgcgtctggcaacgaccggtccctccctgtacctaactttccgtgggtacccttccgaacggcccttaggaacggtaccgaacgttccttaccaccttaaccttaaccttcggtcccttaccctcctaattacgttacgaccctaaggtaactaaacgtttaacggttttcccgtaggggtttacggtttcccgggggacggggtaacgggggtaaccccttaaaggggtttaccgtaccccggttacggttaaaccgggtccgtaaccgggaaccccgtaaacggggtcccttaccccggtaccccccgttacgggttccctaccgttttcccccgg

SEQ ID NO: 316422 - DNA, 521 bp, Homo sapiens
  misc_feature: GZ8MTXP02F3Z0N.51.19.B08.1.454.CMB.2.raw
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctgtaccaacaacacccagcaaagccccaaagtcattattatgagccagtaggcgagcctcagggatttctagtcgcttctctgcctcgcgtctggcacacggcctcctgacatttcnggctcagcctgacgcgagtcncactactactgctcctcatatgcagactaaattcgtttcctggtcgttcgggacggtacggggacctaaggtttgaacccgttcgtaacggtcacgcccgaacggctccgccccctacggtacactttccg

SEQ ID NO: 316423 - DNA, 581 bp, Homo sapiens
  misc_feature: GZ8MTXP02IBEIM.51.19.B08.1.454.CMB.2.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (464)..(464): a, c, t, g, unknown or other
  misc_feature (464)..(464): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactaggaaccagccgtgatagttgggacttatcacttgtctctgtacaacacaccagcaaacgccccaaagtcattattatgagccagtaggcgagcctgaggtatttgagtcgtcttctctcgctcgcgtctggacaacnccgtcctcctgactacgttcgnggcctccgagtccctaggacggtacgngttaccncgtacttactactcgccttcctntatactgaccgataactaaagtttcgtttaccgnggtttcgggttaaccggcgggtaacgggtacctaaaggttcccggtaccgtaccgtacggtaccacggaacccgtaacggcttacccgcccccgttacggtcttaacccgtttcccg

SEQ ID NO: 316424 - DNA, 573 bp, Homo sapiens
  misc_feature: GZ8MTXP02IML5Y.51.19.B08.1.454.CMB.2.raw
  modified_base (376)..(376): a, c, t, g, unknown or other
  misc_feature (376)..(376): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctggtctcctggacagtccatcaccatctcatgcactggaaccagccgtgatattggacttatcacttgtctctgtacaacacaccagaccaaacgccccaaagtcattattatgaggccagtaggcgagtccacgtaggtattcgtagtcgccttctctcgcctccgcgtctggccaacaccggcctcctgactattcgnggctccagcctgacgacgagtctacactactactcgacctcctcattagtacgcctacgaactaaacgtttacggtttccgttgggtcggttccgggacgggtaacggggacctaaacggtttccgaccggttaccgtaacgggtccaacggtcccgaacggtcctccggtcccccgtcggtaccctacgttccccg

SEQ ID NO: 316425 - DNA, 635 bp, Homo sapiens
  misc_feature: GZ8MTXP02HZ4D7.51.19.B08.1.454.CMB.2.raw
  modified_base (311)..(311): a, c, t, g, unknown or other
  misc_feature (311)..(311): n is a, c, g, or t
  modified_base (337)..(337): a, c, t, g, unknown or other
  misc_feature (337)..(337): n is a, c, g, or t
  modified_base (602)..(602): a, c, t, g, unknown or other
  misc_feature (602)..(602): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgacctcagcctgcctccgtgtctggtcctcctggacagtccatcaccatctcatgcacgtaggaaccaggccgtagattagttgggtacttatctaccttgtctcctgtaaccaaacacaccaggaccaaaccgaccccaaagtctatttatttnaggacgcagtagcgagcctagaggtntttcagtcgtccttctcctcgtcctccgtcgttcgtcggaccaacgacccggtcccttaccccgtagtaaccttaagtttccgtcgggtacccttaccgaacggtcccgttaggaacgggtaacgtacgttcctacctacgttaccgtacttctccttctacaattcgcgacaacgtacttaacgttcgtttaccgttgggtcggttcgggacggtaagggtaacctaagttccggaccgttccgtaaggtccaacgtaacccgnggtccctcccgtccccgtacgtcgtccttcccg

SEQ ID NO: 316426 - DNA, 588 bp, Homo sapiens
  misc_feature: GZ8MTXP02GOU6A.51.19.B08.1.454.CMB.2.raw
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (448)..(448): a, c, t, g, unknown or other
  misc_feature (448)..(448): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtagatagttggacttatctacttgtctcctcgtaacaaccaacaccagacaaacgaccccaagtatattatttangacgtcagtaggcgacncgtnagggtattctagtcgtccttctctcgtcctccgcgtcgtcggacaacgacccggtcctccctagtactaagtttccgtcggtccctccacggtccgtaggacgacggtatccttcactacgtacctnccctactcatagtcgacagaactacgtttacgttccgttagggtgttccggggacggttaacggggaactacggtttcgacccgtaccgttacgacgacgaaccgtacgcgtcccgaccccgtcggtacctaccgttccg

SEQ ID NO: 316427 - DNA, 720 bp, Homo sapiens
  misc_feature: GZ8MTXP02H5O40.51.19.B08.1.454.CMB.2.raw
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcngtaccaacaacaccaggacaaacgccccaaagtcattattatgagccagtaggcgagctacgagggtactttctagtcgtccttcgtctcgcctcgcgtctgccaaacnccgtccctcctacgactaacttccgtgggcccttaccgacgcccgtaggtacggaacgacgttaccctacctaccgttaacctacgttccggtacccttccgttacctactttaaagtcggaccgtaaactaaccgttaaaaagtttcgttttaacccggttacgggtttcgggtttacccgggggacggggtaaaaccggggttaccccggttaaaaggtttcccgggaaaacccggttcccgggttaacggttacccggtaaaaccggtaaccccccggtaaaacggggacccccggtttacccggtaccccccccgttttaccgggggtcccctttaaacccccggtttcccccgg

SEQ ID NO: 316428 - DNA, 684 bp, Homo sapiens
  misc_feature: GZ8MTXP02J0S5N.51.19.B08.1.454.CMB.2.raw
  modified_base (338)..(338): a, c, t, g, unknown or other
  misc_feature (338)..(338): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatcaccttgtctcctggtaccaacaaccacccaggacaaacgcccccaaagtcattattatgaggccaggtaggcgagcctcagggtatttctagtcnccttctcgtcgccttccgcgttctgggacctaacaccggcctcccgtgtaacctaatttccgtgggtccttcccgaagccctaggacggaccgtacggtcctaccgtaccttaacctccgttcgacccttaccctacctaattaacgttcgtaccaacggtaaacctaaacgtttaaccgtttcccggttagggtttcgggtttccggggacggggtaagggtaaaccccgtaaacgggtttccgtaccccggttaccgttaacggggtacccaacggtaacccccgtaaaacgggccgttacccccggtcccccccgttcgggtacccctaaccgtttccccggg

SEQ ID NO: 316429 - DNA, 862 bp, Homo sapiens
  misc_feature: GZ8MTXP02JV2XB.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcacgtcggaaccagccgtgaatagttcggggaactttatctaccttgtacctccgtacggtaaccaacaaccacccgaggaccaaacgacccccaaaagtctaactttatttacgtacggacggacccgtaaggtaacgggtaccgaacggtcccgtacggtaaggggttacttttaccgtaacggttccggtcccctttccgtccgttccggtaccccttcccgggtccggttccggtaccggggtaaccctaaaacccggaacccccggggtccccttaccccgttaacggtaaacccttaaacgttttcccggtcgggggtacccttaccccgaaacggtccccggttagggaaccggggtaaccgtacgggttaccccgttacgtaaaccccgttaaccttaaccgttaccgggtacccttcccccgttacgtaagttaccttacgggaacccttaaacggtaaactttaaaacgtttacggtttcccgggttaaggggtttccggggtttaccggggaacgggtaaccgggggttaaacctaaaccggggttcgggtaaaccccgttccggtaacgggtaccgttaaccgaacccggtaacggtcccgttacccggccccccgtttaggtaccctaccggtttcccg

SEQ ID NO: 316430 - DNA, 544 bp, Homo sapiens
  misc_feature: GZ8MTXP02GUEF2.51.19.B08.1.454.CMB.2.raw
  modified_base (298)..(298): a, c, t, g, unknown or other
  misc_feature (298)..(298): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (435)..(435): a, c, t, g, unknown or other
  misc_feature (435)..(435): n is a, c, g, or t
tcagcgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatctacttgtctcctgtaccaacaacacccaggacaaacgccccaaagtcattatttangagccagtaggcagcctcgagggtatttcagtcgtcctttcgtactcgccctccgcgtctcggcaaacgccggccctccngactaatttcgnggcctcgagctagacgacgatccacactactactcgactccctanatatcgacaagactattacgttcctggtgtccggacgacggtactaacgttcgaccgttccgagtccacgaacccgaaggcctccgcccccgtagtaccctctttcccg

SEQ ID NO: 316431 - DNA, 706 bp, Homo sapiens
  misc_feature: GZ8MTXP02FTS6R.51.19.B08.1.454.CMB.2.raw
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtcctccgtggacagtccatccaccatcctcatgcacgtcggaaccngccgtgatagttgggtacttactctaccttgtcctctagtaccaacaaccaccagacaacgacccaatntatattanagacgcagngcgacgctagacggtattcgtagtcgtaccttcctacgtcgtcccgtcgtccgttccgtcggtaccaaccgaccggtccccttacccgtacgtaaccttaacgttttcgccggtaccctacgacggtaccgtagggaacgggtacgtacgttacccttaaccgtaacccttaactcccgttaccgttaccctaccccttaatacgttacgtcggaacccaaggttaaaccttaaacggtttccggttttccggaggggtttaccggtcggggaacggggtacggtaacccgttaggttccgggtaaaccccgttcgtaaacggtccgaaaaccgtcccggtaaacggtcccgtacccccgggtccccttacgggtaccctaccgtttcccccg

SEQ ID NO: 316432 - DNA, 761 bp, Homo sapiens
  misc_feature: GZ8MTXP02FZUQU.51.19.B08.1.454.CMB.2.raw
  modified_base (420)..(420): a, c, t, g, unknown or other
  misc_feature (420)..(420): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctcgccctgactcagcctgcctcgtgtctggtcctctggacagtccatcaccatctcatgactacgtcggaaccagtccgtagtacttaggtttggaaccttatacctacctttgtcccttccgtacggtaacccaaacgaccaacccgacggacctaaaaccggaccccctaaatctagtttaattacgaggtacgaccggtagtacggcgacgtccgacgtaggttattctaggtccttccttccgtacctcgcccttacgccgttacnccggtaaccaaccgtcccggtaccctacccgtagaccgtttaacgtttccgtggttacccgccgtaacggttcccgtaaggggacgtaaccgggtactaccttaaccgtaaccgtaaccgtccgttacgtaccctcccgttacgtaactttaccggacttaacggaaacccgttatacgttttaccggttccggttaaggggttcggttaccggggaaccgggtacggtaaaccggttacggttaccgggtaccttaccgggttacggaaccttaacccgggaacccgtaacgggtcccctacccggggtcccctaaccggttacttacccgtttccccgg

SEQ ID NO: 316433 - DNA, 634 bp, Homo sapiens
  misc_feature: GZ8MTXP02IMVOR.51.19.B08.1.454.CMB.2.raw
  modified_base (336)..(336): a, c, t, g, unknown or other
  misc_feature (336)..(336): n is a, c, g, or t
  modified_base (474)..(474): a, c, t, g, unknown or other
  misc_feature (474)..(474): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgcccctgactcagcctgcctccgtgtctgggtctcctggacagtccatcaccatctcatgcactaggaaccagccgtgatagttgggtacttatctaccttgtctcctgtaccaacacacccaggaccaaacgacccccaaagtctattatttatgagccagtaggcgacgcctgacggtatttntagtcgtccttctcctgtcctccgtctctcgggacaaccgaccggtccctcccgtgaacctaagtttccgtcggggtccttccgaacggcccgtggacggtaccggaatcctacgtacctactacctcgcttaccctnaacttatcgacagtaactaagtttacgtttcggtggttcggttaccggggacgggtagggaccccttaaagggttaccggtacccgtaccgtacggggtaccacggaaccccgtaacggtccgtcccggtccccccgtacggtccctaacctttccccgg

SEQ ID NO: 316434 - DNA, 641 bp, Homo sapiens
  misc_feature: GZ8MTXP02HVW5J.51.19.B08.1.454.CMB.2.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagcgatcgtatacacgaccggtgctcgatttagtgagtcagtaagggggggggtcacaagaggcagcgctctcgggacgtctccaccatggcctgggctctgctgctcctcactctcctcactcaggacacaggatcctgggcccagtctgccctgactcagcctgcctccgtgtctgggtctccgtggacagtccatcacctatctcatgcacgtacggaaccngccgtagattagtggtactatctacttgtctcgtacgtacaacacaccgagacaacgacccaagtcattattnagacgcagtacgacgagtcctacgaggtactttacgtacgtcgtcctcttaccgtcgtcccgtccgtcggtactcgggaccaaaccgtaccggtcccttacccgaacgtaccttaacgtttcccggtcggaccctacccgtacggtcccgtagggtacggaacgtcgtacctactacctacgttacgtctacttccgtataatacgtcgaactaaacgttataaacgtttcgttaccgggtggttcggttaccggacgggtacggtacctaacggttccgaccgtacgttacgcgaccgtaacccgaacggtcctacccgccgtcgtacctacgttccccg

SEQ ID NO: 316435 - DNA, 567 bp, Homo sapiens
  misc_feature: GZ8MTXP02FS89E.51.19.B08.1.454.CMB.2.raw
  modified_base (459)..(459): a, c, t, g, unknown or other
  misc_feature (459)..(459): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtcgtgggtctcctggacagtccatcaccatctcatcgcactacggaaccagccgtgatagttcgggtacttatctacttgtctctgtaccaacacaccagacaaacgaccccaaagtctattattagtgacgccaggtacgcgacgcctagtaggtattcgtagtcgtccttctcgtcgcctcgcgttcgtcggacaacgtccggtcctccgtagtaactactttccgcggtccctacgacgtccgtagacggacgtactcctacaactactactcgtacctcncattactcgacaagtactagttacgttcgtggtcgtcggtacggtacggtactaggtcgtaccgtcgtacgtcacgccgtacgcgtacccgcccgtacgcctcgtccc

SEQ ID NO: 316436 - DNA, 630 bp, Homo sapiens
  misc_feature: GZ8MTXP02JJB3F.51.19.B08.1.454.CMB.2.raw
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatcgacacgtacggaaccagccgtagatagttgggacttatctaccttgtctccgtagtaaccaacaaccacccagaccaaacgccccaaagtctattattatgagccagtaggcgagccgtgagggtatttcgtagtcgtccttctctcgcctccgcgttctggccaacgaccggtccctccgtgtaacctaactttccgtacggtcctccacgtcgtaggacggacgacgttaccacgtaccttacttacgtcgtcctccttacatactgactaacgtaactaagttcgtttccgaggttcgtaccgggtacgggacgggtaaccgtacggttacggacccggttaccgtaacggtccaccggtaacccgtaacgggtcccgttacccggtcccccgttacggtcccgtacctttccccgg

SEQ ID NO: 316437 - DNA, 641 bp, Homo sapiens
  misc_feature: GZ8MTXP02J1LUF.51.19.B08.1.454.CMB.2.raw
  modified_base (228)..(228): a, c, t, g, unknown or other
  misc_feature (228)..(228): n is a, c, g, or t
  modified_base (502)..(502): a, c, t, g, unknown or other
  misc_feature (502)..(502): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctcgccctgactcagcctgcctccgtgtctgggtctcctggacagtccatccaccactctcatcgcacgtacggaaccngccgtatagttagttggtacttagcctacttcgtctcgtacgaaccaacaaccaccacgacaaccaccctaatctatttatatgacgctaggacggcgacgtcctaggtaggttacttgtacgtccgtccttctcgtccgtccgtccgtacgttcgtcgaccaaccgtccgtcctaccgtagtaaccttacgtttccgacggtccctaccggtaagtcccgtagggacggtaacgtcgttacctacttaccttaacccgtcgtcgtcctacctntattacgcgtacagtaacttaacgtttcgttaccggtggttacgtcggggtacggacgtacgtacggttaccgaccgttacgacgtaccgacgaaccggaacgttccgtacccgtcccggtttccgcttaccgttcccg

SEQ ID NO: 316438 - DNA, 621 bp, Homo sapiens
  misc_feature: GZ8MTXP02GGWLW.51.19.B08.1.454.CMB.2.raw
  modified_base (298)..(298): a, c, t, g, unknown or other
  misc_feature (298)..(298): n is a, c, g, or t
  modified_base (470)..(470): a, c, t, g, unknown or other
  misc_feature (470)..(470): n is a, c, g, or t
tcagcgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatagttgggacttatcaccttgtctcctgtaccaacaacacccaggacaaacgccccaaagtcattattangacgccagtaggcgacgcctacgagggtatttcgtagtcgtccttctctcgccctccgtcgtcgtcgggacaaaccgaccggccctccctgtacctaactttccgtcgggcccttacacgccgtagacggtaccgacgttctacacctactactcgcctccttactactacngtaccgaagtactaacgtttcgtttaccggtgggttcggttcgggaccggggtacgggtaacctaaacgttaccgggacccgttaccgtacgggtaccacggaacccgtaaacggccgttacccgtcccccgtcggtcctaccgtttcccg

SEQ ID NO: 316439 - DNA, 592 bp, Homo sapiens
  misc_feature: GZ8MTXP02FNC36.51.19.B08.1.454.CMB.2.raw
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (475)..(475): a, c, t, g, unknown or other
  misc_feature (475)..(475): n is a, c, g, or t
  modified_base (585)..(585): a, c, t, g, unknown or other
  misc_feature (585)..(585): n is a, c, g, or t
tcagcgatcgtatacacgaccggtgctcgatttagtgagtcagtaagggggggggtcacaagaggcagcgctctcgggacgtctccaccatggcctgggctctgctgctcctcactctcctcactcaggacacaggatcctgggcccagtctgccctgactcagcctgcctccgtgtctgggtctccgtggacagtccatcaccatctcatcgcacgtcggaaccaggccgtagtattaggttacgggactttatctacctttgtcctcctacgtaaccaaacaaccacccgaggaccaaacgaccccaaagtctaattattatggacgtccaagtacggcgagtcctcgagggtacttcgtagtcgtcccttctctcgtcctccgcgtcgtcggaccaacgccgtccctccgtagactacttcgnggtcctcacgcgngagactagtctactactactcgtctctcctactatntacgactagaacttacgttacgttcgtggtcggtacggacggtacggaacgtacgttacgaccgttcgtaacgctaaccgccgtaacggctaccccggtccgtcgtaccncttcccg

SEQ ID NO: 316440 - DNA, 549 bp, Homo sapiens
  misc_feature: GZ8MTXP02IN47E.51.19.B08.1.454.CMB.2.raw
  modified_base (222)..(222): a, c, t, g, unknown or other
  misc_feature (222)..(222): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
tcagcgatcgtatacacgaccggtgctcgatttagtgagtcagtaagggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccngccgtgatattggacttatcactgtctcctgtaccaacaacacccaggcaaacgccccaaagtcattatttatgagtccaagtcggcgagcctcgagggtatttnagtcgccttcncttcgccctcggctcgtcggctaaacncgccctccctgaactattctggcctcacnctgacggacgagtctcacctactactgaccttcctcaatgtacanactactaatacgttcgttggtcggtcggtacgggacggtacgtaacgtacgtacgtaccgtacgtacgaccgaaccgacgtaccgtccgcccgtccgtccgtaccgtccg

SEQ ID NO: 316441 - DNA, 595 bp, Homo sapiens
  misc_feature: GZ8MTXP01AIW0U.2.33.C11.1.454.CMB.2.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccatgtgagctgcgactgggtggcgtcgtggggggagcttggngcaggccgggtgggtccctgcgactctcctgtgctaatttcngaacgtcccccttacaatcagtgtggatgaattgggccncaggctccgagggagggctgggagtggggttgacaataaagtaaaagtagactgcgtggagagacaaacgagtactacgctgactgtcccttagagaggcagtactcaacatctanagagatagaatacacagacncacgttnttcgtttcgagaactaaagtacgaaacncgaccgtaagggaaacgacggaccggaacaaccgcgaacctaagttagttatttagttagtaacttagttacggaactaactagtaaccggtcccgtacgggggacctaaccgggttaacccttcccgg

SEQ ID NO: 316442 - DNA, 554 bp, Homo sapiens
  misc_feature: GZ8MTXP01BGCMK.2.33.C11.1.454.CMB.2.raw
  modified_base (256)..(256): a, c, t, g, unknown or other
  misc_feature (256)..(256): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgccattttaaaggttccatgtgagctgcgactgggtggcgtcgtggggggaggcttgggtgcaggccggggtgggtccctgcgactctcctgtgctaatttcngaacgccccctttacaatacagtgtggatgaattgggtccgccaggctccgagggagggctggagtgggtgcatataaaagtagactgctggngagacaacngactacgctgctgcctnagagcagatcaccatctcagagatgaaatcacagancactcttgtttcngacaaatgaaacngacctagggaaacgacgacggacacgacgcctaattgtaaattattagtaacttaagtttaggactaacttagtaacgtaccccggtggggacccgtaacggggttaacccctccgg

SEQ ID NO: 316443 - DNA, 543 bp, Homo sapiens
  misc_feature: GZ8MTXP01DHVL4.2.33.C11.1.454.CMB.2.raw
  modified_base (254)..(254): a, c, t, g, unknown or other
  misc_feature (254)..(254): n is a, c, g, or t
  modified_base (374)..(374): a, c, t, g, unknown or other
  misc_feature (374)..(374): n is a, c, g, or t
  modified_base (520)..(520): a, c, t, g, unknown or other
  misc_feature (520)..(520): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggatttcctgctgccatttaaaggttccactgtgagctgcgactgggtggcgtcgtggggggaggcttggtgcaggccgggtgggtccctgcgactctcctgtgcaatttcngaacgcccccttacaatacagtgtggatgaattgggtccgcaggctccgagggagggctggagtgggtgcataataaaagtagactgctggtgagacaacagactacgctgctgcccttnagaggcagatcacatctcagagatagaatcaacagagacacttacttgtttctacgactaaaatcgaaacagccgtaggaaacgaccgcggaacacaagcctattgtattattagtattagttaggaactaactataacgtcccgnggggacctaacgggaacccctcg

SEQ ID NO: 316444 - DNA, 576 bp, Homo sapiens
  misc_feature: GZ8MTXP01D2QX4.2.33.C11.1.454.CMB.2.raw
  modified_base (264)..(264): a, c, t, g, unknown or other
  misc_feature (264)..(264): n is a, c, g, or t
  modified_base (393)..(393): a, c, t, g, unknown or other
  misc_feature (393)..(393): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgcctattttaaaaggttccactgtgagctgcgactgggtggcgtcgtggggggaggcttgggtgcgaggcccggggtgggtccctgcgactctcctgtgctaatttcngaacgcccccttacaatacagtgtggatgaattgggtccgccaggctccgaggggaagggctgggagtggggttgccaataataaaaagtagactgctggtgagacaacagactacgctgactgccttnagaggcagacttcacctatcttcagagatagaaatcaacagagcaacttctgtttctgtacaaatacgaaacagccgtaggaaacgacggacggaacacagcctagttagtattagttagtaacaagtttaggaactaacttagtaacgtcccggtacggggcctaacgggttaacccgtccg

SEQ ID NO: 316445 - DNA, 545 bp, Homo sapiens
  misc_feature: GZ8MTXP01EA32Q.2.33.C11.1.454.CMB.2.raw
  modified_base (382)..(382): a, c, t, g, unknown or other
  misc_feature (382)..(382): n is a, c, g, or t
  modified_base (435)..(435): a, c, t, g, unknown or other
  misc_feature (435)..(435): n is a, c, g, or t
  modified_base (521)..(521): a, c, t, g, unknown or other
  misc_feature (521)..(521): n is a, c, g, or t
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccgagggaaggggctggagtgggttggccatataaaaagtagactgctggtgagacaacagactacgctgctgccttcagaggcagattcaccatcttcagagatgaatcacagagcactcttgttctgcaaatgaacagcctaggaagacgcggacacagccatgtattatgtacattacgactactatacgtcccgtaggggccaaggggaccctcgtcaccgtctcctnacgcctcaccaacgggccatcggtccttcccctgccgcctcgcctccgaggcnccacctccgacgagccacgacgcccggccctggggctcggcccgtgggtcaaacgggtcttacttcccgtggttccgagcgttcgnggcggcggcgcggaacgaacggcg

SEQ ID NO: 316446 - DNA, 646 bp, Homo sapiens
  misc_feature: GZ8MTXP01AKXKF.2.33.C11.1.454.CMB.2.raw
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctcccgtcccccttcgcagtaacaccaagtacagaatattaacctgttcccatcgactacgccttcggcctcgccttagggtcactcaccctgccccgattacgtgacaggacctgtctcggcgagcggtctttcaccgtctttatcgttacttatgtcagcaattcgctacttctgactacctcagcatcgcctcacacgcaacctaccttcaacgacgggtaccttaaccgggaaccctcccttaccccccgtaaacccaaaccgaaaccgacctaaacgtaaacgccgttaccgcctcggccccgtcgtacgtccgttcgggtcgcgtaacgttcgggttttaccgtcccccgttttcaccgtttccccgttccccgcctaacttccgtaggttacgttcggttcggtaacggg

SEQ ID NO: 316447 - DNA, 618 bp, Homo sapiens
  misc_feature: GZ8MTXP01A1VAO.2.33.C11.1.454.CMB.2.raw
  modified_base (181)..(181): a, c, t, g, unknown or other
  misc_feature (181)..(181): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccggcaacatacgccttctccgtcccccttgcagtaacaccaagtacagaatattactgttccatcgactacgccttcggcctcgcttagggcactcacctgcccatacgtgacagacctgctcggngagcggtctttcaccgtnttatcgttactatgtcagcaattcgctacttcngactacctcagcatcgcctcacagcactaccttacacgaggtaccttaacggaacctccctaccccgtaaccaactaacgcaagtaacgccgttcgctcgcccgtacacgtcgttcggcgacccgttaagtttccgggttttaaaccgtccccccgtttttacgcccgtttccccgttaaccccgtcttaacgttcgtacggttacgttccggttaaccggtaacgg

SEQ ID NO: 316448 - DNA, 404 bp, Homo sapiens
  misc_feature: GZ8MTXP01EVW7Y.2.33.C11.1.454.CMB.2.raw
  modified_base (296)..(296): a, c, t, g, unknown or other
  misc_feature (296)..(296): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (403)..(404): a, c, t, g, unknown or other
  misc_feature (403)..(404): n is a, c, g, or t
tcagacgctcgacacacgaccggtgctcgatttagagtgagctcgttgggttggccatataaaaagtagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccccgtgggggccagggacccctcgtcaccgtctcctcagccctccaccaagggcccatcggtccttccccctggcncccctgctcccaggagcaccctccgagagcacagccggccctgggctgccgtggtaccaaaagccttcttcctgtcgancgtcnggcgcgggcnggcaggcnanagnn

SEQ ID NO: 316449 - DNA, 526 bp, Homo sapiens
  misc_feature: GZ8MTXP01AI6BF.2.33.C11.1.454.CMB.2.raw
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctaggaagacgcggacacagccatgtattattgtacattacggacatatagtccctggggccaagggaccctcgtcacccgtctcctcagccctcaccgaagggcccatccggtcttccccnggcnccctcgctcaggacggcaccgtccgagagcacagccggccctgggctcgcctggtcaaggccttacgttccgtgttcgagcgtctgaacgtcggcgttcggcgaaggcg

SEQ ID NO: 316450 - DNA, 564 bp, Homo sapiens
  misc_feature: GZ8MTXP01AO4YG.2.33.C11.1.454.CMB.2.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (421)..(421): a, c, t, g, unknown or other
  misc_feature (421)..(421): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgcctattttaaaaggttccactgtgagctgcgactgggtggcgtcgtggggggaggcttgggtgcgaggccggggtgggtccctgcgactctcctgtgctaattttcngaacgtccccccttacaaatacagtgtggatgaattgggccncaggctccgagggagggctggagtgggtgcatataaaagtagactgctggtgagacaacgagactacgctgactgcctcgagaggcagatcaccatctcagagatgaatcacagancactcttgttctagactaaatagaactagccgtagggaacgacggacggacacagcctaattcgttattagttagtaacttagttacggaactaactactaacggtcccgtacgggggcctaacggggttaaccccgtcccgg

SEQ ID NO: 316451 - DNA, 624 bp, Homo sapiens
  misc_feature: GZ8MTXP01ED1ZM.2.33.C11.1.454.CMB.2.raw
  modified_base (356)..(356): a, c, t, g, unknown or other
  misc_feature (356)..(356): n is a, c, g, or t
  modified_base (546)..(546): a, c, t, g, unknown or other
  misc_feature (546)..(546): n is a, c, g, or t
tcagacgctcgacacacgaccggtgctcgatttagagtgagctcgttggggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggcaacatacgccttctcccgtcccccttgcagtaacaccaagtacagaatattaacctgttcccatcgactacgcctttcggcctcgcgttagggtcactcaccctgccccgattaacgtgacaggaccttgtctcggngacgcggtctttcaccgtctttatcgttactatgtcagctaattcgctacttctagactaccctccagtctagtcacctacaacacgaccaacctaccttacaactacggaccttaacaacgaaccctccctacccctaaccaaacacacaacgtaacgccgtacgctcgccgcacgtcgttacgggttntacgttacgttaccggttaccgttcccgtttcttaccttcccgtacccgtctacgttcgttacgtaacgttcgtaacg

SEQ ID NO: 316452 - DNA, 602 bp, Homo sapiens
  misc_feature: GZ8MTXP01B29X7.2.33.C11.1.454.CMB.2.raw
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactgggtggcgtcgtgggggaggcttggtgcaggccgggtgggtccctgccgaccctctgtgcattctgaacgccccttaccaatacagtgtggatgaattgggtccgccaggcgtcaggggaaggggctggaggtgggttggccaataataaaaagtaaagactggctggtgagacaacacgactacgctgctgccttcagaggcagnttcaccatcttcagagactgaaatcgacaggaacnctactcgtttgtttacaggaactaaaatcgaaacgtacggcgaaggaaacggaaccgcgtaacacgagtcctaagtttgttaatttattcgtaaactaagttaacggacttacgttaagtcccgggttcccggtcgggggacccgttaaccgggttaaccccgttcgtcccg

SEQ ID NO: 316453 - DNA, 387 bp, Homo sapiens
  misc_feature: GZ8MTXP01DKNZB.2.33.C11.1.454.CMB.2.raw
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (385)..(387): a, c, t, g, unknown or other
  misc_feature (385)..(387): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttaggggtcactcaccctgccccgattaacgtgacaggaccccttggtcttccggngagcgggctggcaaggcncatagnnn

SEQ ID NO: 316454 - DNA, 608 bp, Homo sapiens
  misc_feature: GZ8MTXP01AXBCG.2.33.C11.1.454.CMB.2.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaggttccactgtgagctgcgactggtggcgtcgtggggggagcttgggngcgaggccggggtgggtccctgccgactctcctgtgctaatttcngaacgtcccccttacaatcagtgtggangaattgggccncaggctccgagggagggctgggagtgggtgcaataataaaaganactgctgggtanagacaacagactacgctgctggccttgaggagcagcttcgaacctattctacagagatagaatacaacagganacctacttcgttcgttttaccnggtaacctaaaagtcgaaacgtacgaccgtaggggaaacgccggtaccggaacacgacgtaaccagttaggttatttacgttagtaaccttagtttacggactaacgttacgtaacggttccccggtgggggaccctaacggggttccccttaacccgg

SEQ ID NO: 316455 - DNA, 591 bp, Homo sapiens
  misc_feature: GZ8MTXP01CZ7YP.2.33.C11.1.454.CMB.2.raw
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(427): a, c, t, g, unknown or other
  misc_feature (426)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttagggtcactcaccctgccccattaacgtggacaggaaccccttggtcttccggcgagcggggctttcgaccgagttactcgtaccttangtcagcaattcgcactctnatactccncncnncncncacacacacactacacacgacgtacgaccgaccacccgtacccaacaaccacactaacgacgtcgctcgtccgcgcgtcgtcgtcgcgtacgttcggttaccgttcccgttccgttccttccttcccgtacctaaccgtctcgttacgtcgttcgtaacg

SEQ ID NO: 316456 - DNA, 569 bp, Homo sapiens
  misc_feature: GZ8MTXP01CFLEZ.2.33.C11.1.454.CMB.2.raw
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaagggctggagtgggttggccataataaaaagtaagactgctggtgagacaacagactacgctgctgccttcagaggcagattcaccatcttcagagatgaatcacagagcactctgtttctgacaaatgaacagcctaggaagacgcggacacagccatgtattattgacattacgacatatacgtccctaggggcccaagggaaccctcgtcaccgtctcctcacgccctccaccaacgggcccagtccggtccttcccccgtcggcccgccctcgcctccgacggacgccaccgtccgagacgcacgacgcccggccgtggggcctcggcccgtgggtaccaagggtaccttacgttcccgtggttcggcgttccgttcgtggaacggcgggcgttcggccgaagggccg

SEQ ID NO: 316457 - DNA, 625 bp, Homo sapiens
  misc_feature: GZ8MTXP01CELLZ.2.33.C11.1.454.CMB.2.raw
  modified_base (261)..(261): a, c, t, g, unknown or other
  misc_feature (261)..(261): n is a, c, g, or t
  modified_base (395)..(395): a, c, t, g, unknown or other
  misc_feature (395)..(395): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaggttccactgtgagctgcgactgggtggcgtcgtggggggagcgttgggtgcgaggccggggtgggtccctgcgactctcctgtgctaattttcngaacgtcccccttacaatacagtgtggatgaagttcgggtccgccgaggctccgagggggagggctgggagtgggtggaccaataataaaaagtagactgctggtagagacaaaccagactacgctgctgcctnagaggcagacttcacctatcttacagagtatagaaatcaacaggacactaacttcttaggtttacctaggtaacctaaaagttacgaaacgacgacccgtaagggaaacgaccggaccgggaacacgaacggaacctaagttgttaaattacgttagtaacttaagttacggactaacgtataaccgggtcccgtacgggggacccgtaaccgggttaacccctaaccgg

SEQ ID NO: 316458 - DNA, 555 bp, Homo sapiens
  misc_feature: GZ8MTXP01BB3YL.2.33.C11.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactggtggcgtcgtgggggagcttggtgcaggccggggtgggtccctgcgactctcctgtgctaatttcngaacgcccccttacaatacagtgtggatgaattgggtccnccaggctccgagggagggctgggagtgggtgcaataataaaagtagactgctggngagacaacagactacgctgctgccttacagacggcagtacttcacctatctcagagatgaatcacagagcactcttgttcngacaaatgaaacngccgtaggaaacgacgaccggaacacgacgcctaagttcgtaaatttagtagtaacttagttaaggactaactagtaacgtcccgaggggaccctaacgggaaccctccg

SEQ ID NO: 316459 - DNA, 589 bp, Homo sapiens
  misc_feature: GZ8MTXP01DRYMV.2.33.C11.1.454.CMB.2.raw
  modified_base (462)..(462): a, c, t, g, unknown or other
  misc_feature (462)..(462): n is a, c, g, or t
  modified_base (517)..(517): a, c, t, g, unknown or other
  misc_feature (517)..(517): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgccttaggggtcactcaccctgccccgattaacgtggacaggaaccctggtctccggcgagcgggctttcacccgtctttatcgttacttatgtcagcaattcgctacttctgactacctccagcatcgcctcacagcacaccttcacaggcttacggaacncctacccctaccaacaaccgacaactaacgcgtcgactcgccgcagtcttcgggnttcgaacgttcgggttaccgtcccccgtttagcttcccttccccgcctaactcctgactcggttcgtaacgg

SEQ ID NO: 316460 - DNA, 588 bp, Homo sapiens
  misc_feature: GZ8MTXP01AVH2O.2.33.C11.1.454.CMB.2.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccgaggggaaggggctggagtgggttggccataataaaaagtaagactgctggtgagacaacagactacgctgctgccttcagaggcagattcaccatcttcagagatgaatcacagagcactctgtttcngacaaatgaacngcctaggaacgacgcggaacacagccattgttattattagtactagttacggactactagtacgtcccgtaggggcccaaggggtaccctcgtccaccgtctcctcacgccctccaccgacggcccagtccgtcctccccgtggccgccctcgcctaccgacggccggcctacccgtaccgacggacgccgaccgcggcccggcccgtgggcctcggcccgtgggtaccaagggtacccttacgttccgtaggttccgcgttccgtgtcggcggcgggtcgcgggtcgaaggccg

SEQ ID NO: 316461 - DNA, 573 bp, Homo sapiens
  misc_feature: GZ8MTXP01BSKLB.2.33.C11.1.454.CMB.2.raw
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
tcagacgctcgacacacgaccggtgctcgatttagagtgagctcgttgggtttgggagcccagccttgggattcccaagtgttttcattcagtgatcaggactgaacacagaggactcaccatggactttgggctgaggtggattttcctgctgccattttaaaaggttccactgtgagctgcgactggtggcgtcgtggggggaggcttggtgcaggccgggtgggtccctggcgactctcctgtgctaatttcngaacgccccttcaatacagtgtggatgaattgggtccncaggctccgagggagggctgggagtgggttgcaatataaaagagatgctggtgagacaacagactacgctgctgccttanagaggcagattcactatcttcagagatagaatcanagacgctaactcttgtttctagacctaaaagtcgaaacacggacccgtagggaaacgaccggacgggaccacgaggcctaattgtaatttagtagtacttaagtttaggaactaacgttaagtcgtcccggtacggggaccctaacggggttaacccttcccgg

SEQ ID NO: 316462 - DNA, 388 bp, Homo sapiens
  misc_feature: GZ8MTXP01CEMRU.2.33.C11.1.454.CMB.2.raw
  modified_base (385)..(388): a, c, t, g, unknown or other
  misc_feature (385)..(388): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggcaaccgtcgcccggcaacatagccttctcccgtccccccttgcagtaacaccaagtacaggaatattaacctgttcccatcgactacgcctttcggcctcgccttagggtcactccaccctgaccccgattaacgtggacaggacccttggtcttccggcgtagcgggctggcaaggcgcatagnnnn

SEQ ID NO: 316463 - DNA, 651 bp, Homo sapiens
  misc_feature: GZ8MTXP01DRNXZ.2.33.C11.1.454.CMB.2.raw
  modified_base (384)..(384): a, c, t, g, unknown or other
  misc_feature (384)..(384): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaaccagcctacacgacttaaaaccgggacaaccgtcgcccggccaacatacgccttctcccgtcccccttcgcagtaacacaagtacaggaatattaacctgttccatcgactacgccttcggcctcgcttagggtcactcacccctgccccgtattaacgttggacacggaacccttggtcttccggcgagcggtctttcaccgtntttactcgttaccttatgtcagctaattcgctacttctcgaactaccctcagctatcgaccctcacacgaccaactacccttacaacgacgggtaccttaaaccgggaaacctccccttaacccccgaaacccaaacaaccgacaaactaaacgccgttcgactcggcccacgtacgtccgttaacggtcggttacctaggtttcggtttaaccgtccccgttttacacttcccttccccgcctaattcctgacttcgttcggaacg

SEQ ID NO: 316464 - DNA, 558 bp, Homo sapiens
  misc_feature: GZ8MTXP01AK3FE.2.33.C11.1.454.CMB.2.raw
  modified_base (277)..(277): a, c, t, g, unknown or other
  misc_feature (277)..(277): n is a, c, g, or t
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaagggctggagtgggttggccatataaaaagtaagactgctggtgagacaacagactacgctgctgccttcagaggcagattcaccatcttcagagatgaatcacagagcactctgtttcngacaaatgaacagcctggaagacgcggacacagccatgtattatgtacattacggacatatacgtccctaggggcccaagggaaccctcgtaccacccgtctcctcacgccctccaccgaacgggcccatccggtccttcccccgtggcccgccctcgcctccgacggacggccacccgtccgacgacgccacgacgccggcccgtgggcctgcccgtggtaaacggcttaccttccgtgtccgagttcgttcgtggcggcgggctgggcgaaggcgaacg

SEQ ID NO: 316465 - DNA, 577 bp, Homo sapiens
  misc_feature: GZ8MTXP01AM7SF.2.33.C11.1.454.CMB.2.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgcctattttaaaggttccactgtgagctgcgactgggtggcgtcgtggggggagcgttggtgcgaggccgggtgggtccctgcgactctcctgtgctaatttctagaacgtcccccttacaatacagtgtggangaattgggtccncaggctccgagggagggctggagtgggtgcatataaaagagactgctggtgagacaacagactacgctgactgcccttgagaggcagtacttcacatctacagagatagaatcanagacgctactnttgtttctagactaaatcgaaacagccgtaggaaacgacggaccggaacacgacggcctaagttcgttaattagttacggtaacttagtttacggactaactagttaaccggtcccggtagggggaccctaacggggaaccccttcccgg

SEQ ID NO: 316466 - DNA, 603 bp, Homo sapiens
  misc_feature: GZ8MTXP01ASROU.2.33.C11.1.454.CMB.2.raw
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaaggttccactgtgagctgcgactggtggcgtcgtggggggagcttggtgcaggccgggtgggtccctgcgactctcctgtgctaatttcngaactcccccttacaatacagtgtggatgaattgggtccgcaggctccgagggagggntggagtgggtgccaataagtaaaagtagctgctggtagagacaacgagactacgctgacctgtcccttanaggacggcagacttcacctatcttacagtagatagaactcaacagacgtcacttcttcgtttctacgactaaacgtgaaaccgcgacccgtagggaaacgaccggccggaacaccgagtaacctagttagttaaattagttacgtaacttacgttaacggactaacgtacgtaaccggtacccggtcgggggaccctaacggggttaaccccgttccg

SEQ ID NO: 316467 - DNA, 679 bp, Homo sapiens
  misc_feature: GZ8MTXP01EW5YM.2.33.C11.1.454.CMB.2.raw
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccgagggaaggggctggagtgggttggccatataaaaagtagactgctggtgagacaacagactacgctgctgccttcagagcagattcaccatcttnagagatgaatcacagagcactnttgtttcngacaaatgaaacngccgtaggaacgacgcggacacgagcctagttgtatttagtgtactagttaccggactacgtagtcgtcccggtaggggacccaacggggaaccctcgtcctacccgtctcccgtcaacgccctaccgaaccgaacgggtcccctaacgttcccgggttcccctcccccgttggccccgccccgttgcccgtaccgacggacggccctaaccgccggacgaaccgcccgacgaccgggcccgggtcccgttggggacccttcgggccccttaaggggttaacccaaacggggtacctttacccggttccgttcggttaccgggttacggttcccggttcggcggtaaccgggccgggggtacgttcggggaaccgttaacggggtccc

SEQ ID NO: 316468 - DNA, 655 bp, Homo sapiens
  misc_feature: GZ8MTXP01AQQWD.2.33.C11.1.454.CMB.2.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (456)..(456): a, c, t, g, unknown or other
  misc_feature (456)..(456): n is a, c, g, or t
  modified_base (466)..(466): a, c, t, g, unknown or other
  misc_feature (466)..(466): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagtcgttggtgcgaggccgggtggtccctgccgactcctcgtgtnactattcgagacctccctacatacgtgtgtaganagtagtcggtccacgngcgtacggagggaggtcgtgggtggtgggtacgaactaaagtaaaagtaaaaggtagacgtggtacgtagggtaagaacgaactaaccgacggtacgtacgtcgtcgtacgttccgtcctagaggacgactagtactaccactattctagagatanagactacganagctactacttgtttacgttcgaacgtaaacgtaagtacgaaaccgcgtacggaacggaaaccggccggtaccgaacaaccgtcgaacttagttagtttaaattgtaaacgtaacgttaggttacgttacctaacgttccggtccggttcccggggaacgggttaccctaaccgggttaacccctccgg

SEQ ID NO: 316469 - DNA, 656 bp, Homo sapiens
  misc_feature: GZ8MTXP01APOMM.2.33.C11.1.454.CMB.2.raw
  modified_base (380)..(380): a, c, t, g, unknown or other
  misc_feature (380)..(380): n is a, c, g, or t
  modified_base (557)..(557): a, c, t, g, unknown or other
  misc_feature (557)..(557): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggccaacatacgccttctcccgtcccccttcgcagtaacaccaagtacaggaatattaacctgttcccatcgactacgccttcggcctcgcttaggggtcactcaccctgccccgtattacgtggacaggacccttggtcttcggcgagcgggtctttcaccgtntttatcgttacttatgtcagctaattccgctacttctgactaccctcagccatcgcctcacagccaacctaccttcaacgtacggtaccttaaccgggaacctcccctaccccctaacccaaacaaccgacaataacgccgtacgcctacggcccgcgacggtccgttaacggggtnaccgttacggtttcgggttttaacccgtcccccggtttttacaccgtttccccgttccccggccttaacgttccgtggacggttccggaacggttccgg

SEQ ID NO: 316470 - DNA, 542 bp, Homo sapiens
  misc_feature: GZ8MTXP01AQ6Y6.2.33.C11.1.454.CMB.2.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (438)..(438): a, c, t, g, unknown or other
  misc_feature (438)..(438): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggaggcttggtgcaggccgggtgggtcccctgcgactctcctgtgctaatttcngaacgcccccttacaatacagtgtggatgaattgggccncaggctcgagggagggctggagtggtgcaatataaaagtagactgctggtnagacaaccagactacgntgctgccttcagagcagattcaccatctcagngatgaatcacagagcactctagtttctagacaaatgaaacngcctaggaaacgcgcggacacgagccaattggtaatttagtagtaacagttaggactaacgtagtaacgttcccgtacggggacctaacggggttaacccctcg

SEQ ID NO: 316471 - DNA, 652 bp, Homo sapiens
  misc_feature: GZ8MTXP01BY67Y.2.33.C11.1.454.CMB.2.raw
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
  modified_base (410)..(410): a, c, t, g, unknown or other
  misc_feature (410)..(410): n is a, c, g, or t
  modified_base (492)..(492): a, c, t, g, unknown or other
  misc_feature (492)..(492): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaggttccactgtgagctgcgactgggtggcgtcgtggggggaggtcttggtgcgaggccggggtgggtccctgcgactctcctgtnctaatttcngacgtcccccttacaatacagtgtggatgtaagttcgggtccgccaggcctccggagggggaggggctggggaggtggggttgcctaagtaaataaaaggtagactgcgtaggtagagacaaaccgagactacgctagctcgtcccttnagggaggacagtacttaccaacctattcttacgagtagtaagtagaaactcgaacaggactcctacttcgttcgttttacgngtaacaaatcggaaacctacggtaccgtagggaaacgaccggacggaaccaccgagaacctagttagttacttaacgttcggtaaaccttaagttcggaacctaactacgttaacggtccccgggtacgggaccccgtaaccgggttaaccccgttccgg

SEQ ID NO: 316472 - DNA, 636 bp, Homo sapiens
  misc_feature: GZ8MTXP01BHPER.2.33.C11.1.454.CMB.2.raw
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaggttccactgtgagctgcgactgggtggcgtcgtggggggaggcttgggngcgaggccggggtgggtccctgcgactctcctgtgctaatttcngaactcccccttacaatacagtgtaggatgaagttcgggtccnccgaggcctaccggaggggaaggggctggggaggtggggttacgacctaaagttaaagtaaaaaaggtagactggcttagggngaagaacaacgagactacgctgctgtcccttagaggtaggcaagtacttaccacctatctacgagagatagaaatcaagagacactacttcttcggtttactacgtaactaaagtacgaaccaggtaccgtaggaaacgcggacgacacgacgaactagttagttaattacgttagtaacttaacgttaggaccctaagttacgtaacggtcccggtacggggacccgtaacgggttaacccgttcccg

SEQ ID NO: 316473 - DNA, 807 bp, Homo sapiens
  misc_feature: GZ8MTXP01ET6Y9.2.33.C11.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtgatttctgctgccatttaaaggttccactgtgagctgcgactgggtggcgtctggggggagcttggtgcaggccggggtgggtccctgcgactctcctgtgctaatttcngaacncccccttacaaatacagtgtggatgattcgggccnccagggtcctacgggaaggggtacggtcgtaggtagggttggggtacgactaaagttaaaaagtaaaaaggtacgtacgtcggtacggttagggtaacggaaactaaccgtaacccgaaaccggttaaccgtacccggtcggtaccgtaaccggttaccccgttaaccgttaacggaacggggacggtacctaacgttaccttaacccaaaccgtttacttaccgtaaacgaaagggtaactaagtaacggtaacctaaccgaacgaggtaccaccttaccgttcgtttacgtttacgggacgtaaaacgtaacgtaaccgaaaccgaccggtaacgggaaacggaccggaaccgggaaccgtaaaccctaacggtacctaacttaggtttactttaaagttttacggtaacttaaacgttacggttaaccgttaccgttaaaccgttaccgggttaaccccgggtcccggggtacccggggaacccggttaaacccccgggttcccggtcccccg

SEQ ID NO: 316474 - DNA, 574 bp, Homo sapiens
  misc_feature: GZ8MTXP01AZIZ0.2.33.C11.1.454.CMB.2.raw
tcagacgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgttctgacaaatgaacagcctaggaagacgacggacacagccatgtattatgtacattacgacatatacgtcccgagggccaagggaccctcgtacaccgtctcctcacgccctacaaccgaacgggcccagtccgtccctccccgtcggccgccctcgcctccgacggacgacaaccgtccgagacgccgacacggccggcccgtgggcctcggcccgttaagggttaaacgccttaaccgttccgtcggtcgacgttccgttacgtggacggccgggtcgtcgggacgtaaggccggtaag

SEQ ID NO: 316475 - DNA, 529 bp, Homo sapiens
  misc_feature: GZ8MTXP02H9M6D.2.33.C11.1.454.CMB.2.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
tcagacgctcgacacacgaccggtgctcgatttagagtgagctcgttgggtttgggagccccagccttgggattcccaagtgtttcattcagtgatcaggactgaacacagaggactcaccatggactttgggctgaggtggattttccttgctgccattttaaaaggttccactgtgagctgcgactgggtggcgtctgggggaggctttggtgcaggccgggtgggtccctgcgactctcctgtgcaatttcngaacgccccttcaatacagtgtggatgaattgggtccnccaggctcagggagggctggagtggttgccataataaaagtagactgctggtgagacaacagactacgctgctgccttcgagngcagattcaccatctanagtagatgaaatcaacagagcactctgtttcngtacaaatgaacagcctaggaacgacgcggacacgacgtccattgtattattgtacattacggactaactatacgtcccgtaggggaccacgggtaaccctcgg

SEQ ID NO: 316476 - DNA, 553 bp, Homo sapiens
  misc_feature: GZ8MTXP02J34EU.2.33.C11.1.454.CMB.2.raw
  modified_base (453)..(453): a, c, t, g, unknown or other
  misc_feature (453)..(453): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgccggccaacatagccttctccgtcccccttgcagtaacaccaagtacagaatattaacctgtttcccatcgactacgccttcgcctcgccttagggtcactcaccctgccccgatacgttgacaggaaccctggtctccggcgagcggctttcaccgtcttactcgttacttatgtcagcattcgcacttctgactacctcagcatcgcctcacagcacaccttcacacggcttaacggaccncctaccccaccacaacgcaatacgcgtcgctcgccgcacgctcgtcgcacgtcgttacgtcccgttcctactcctcccgtccactctcgtctcgtcgacg

SEQ ID NO: 316477 - DNA, 534 bp, Homo sapiens
  misc_feature: GZ8MTXP02F7LJQ.2.33.C11.1.454.CMB.2.raw
  modified_base (440)..(440): a, c, t, g, unknown or other
  misc_feature (440)..(440): n is a, c, g, or t
tcagacgctcgacacacgaccggtgctcgatttagagtgagctcgttgggtttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaaatgacagcctaggaacgacgcggacacagccatgtattattgtacatagacatatagtcctgggccagggaaccctcgtacaccgtcnccgtcacgcctccaccaacgggcccactcggtccttcccccgtggccgcccgtcgcctaccgaacggacgccaccctccgacgaacgccaaccg

SEQ ID NO: 316478 - DNA, 543 bp, Homo sapiens
  misc_feature: GZ8MTXP02JCXDR.2.33.C11.1.454.CMB.2.raw
  modified_base (255)..(255): a, c, t, g, unknown or other
  misc_feature (255)..(255): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggttccactgtgagctgcgactggtggcgtctgggggaggcttggtgcaggccgggtgggtcccctgcgactctcctgtgcaatttcngaacgccccttcaatacagtgtggatgaattgggtccgccaggctccgaggggaaggggctgggagtgggttggccatataaaaagtagactgctggngagacaacagaatacgctgctgccttnagagcagnttcaccatctcagagatgaatcacagagcacttctgtttccagtaccaaagtcgtaaacacgaccgtagggaaacgacggcgggaacacgaacgccagtgtaacttattacgtacataggacaacgtatacgtcctaggggccacgggaccctcg

SEQ ID NO: 316479 - DNA, 560 bp, Homo sapiens
  misc_feature: GZ8MTXP02IV402.2.33.C11.1.454.CMB.2.raw
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggttccactgtgagctgcgactggtggcgtctgggggagcttggtgcaggccgggtgggtccctgcgactctcctgtgctaatttctgaacgcccccttacaatacagtgtggatgaattgggtccncaggctccgagggagggctggagtggtgccatataaaagtagactgctggtgagacaacagactacgctgctgccttnagagcagattcactatctacagagatgaatcaacagacgctactcttgtttctagacaaagtgaaacagccgtaggaacgacggcgacacgacgtaccagttacgttattaagttacgtaactaattacggaactaacgtacgttaacggtcccgtaggggaccctaacggggtacccccttaccgg

SEQ ID NO: 316480 - DNA, 595 bp, Homo sapiens
  misc_feature: GZ8MTXP02JPVCT.2.33.C11.1.454.CMB.2.raw
  modified_base (448)..(448): a, c, t, g, unknown or other
  misc_feature (448)..(448): n is a, c, g, or t
  modified_base (539)..(539): a, c, t, g, unknown or other
  misc_feature (539)..(539): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgccttaggggtcactcaccctgccccgattaacgtggacaggaacccttggtcttccggcgagcgggctttcgacccgtcttactcgttaccttatgtcagcattcgctacttctgtactacctccagccatcgccctcacagccacncccttcacaggtccttaacggaaaccgtccctaccccctaacccaacaaccgcaaataacgccgttcgctacgccgcagtccttcgggtcnctacgttcggttaccgtcccgttacacttcctcccgctactctgtcttcgtcgtcg

SEQ ID NO: 316481 - DNA, 555 bp, Homo sapiens
  misc_feature: GZ8MTXP02IZJEL.2.33.C11.1.454.CMB.2.raw
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgccattttaaaggttccatgtgagctgcgactgggtggcgtcgtgggggaggcttggtgcaggccgggtgggtccctgcgactctcctgtgcaatttctgaacgccccttccaatacagtgtggatgaattgggtccgccaggctccgaggggaaggggctgggagtggggttggacctaagtaagtaaaaagtagactgctggtgaagacaacagactacgctgctgccttnagaggcagatcacatcttcagagatgaatcanagagcacttctgtttccagacaaaatgaaacagccgtaaggaacgacgcggaacacagacctagtgtattatagtacaagttacggaactaactacgtacggttaccccgaggggtacccgaacggaacccctccgg

SEQ ID NO: 316482 - DNA, 606 bp, Homo sapiens
  misc_feature: GZ8MTXP02HKGAY.2.33.C11.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (390)..(390): a, c, t, g, unknown or other
  misc_feature (390)..(390): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgcctattttaaaaggttccactgtgagctgcgactgggtggcgtcgtggggggagcgttgggtgcgaggccggggtgggtccctgcgactctcctgtgctaatttcngaacgccccttacaatacagtgtggatgaattgggtccnccaggctccgaggggagggctgggagtggggtggaccagtaataaaaagtagactgctggtgagacaacagactacgctgctgccttnagagcagattcaccatctcagagatgaatcacagagcactcttgtttctagacaatacgaaacacgacgtaggaacgacgacggaacaacgacgaccctattacgttatttacgttaagttaacgtaaagtttaacggaaacctaacgtttaacgttaaccggttaccccggttacgggggaaccccgtaaccgggggtaaaccccctttccccgg

SEQ ID NO: 316483 - DNA, 587 bp, Homo sapiens
  misc_feature: GZ8MTXP02HM764.2.33.C11.1.454.CMB.2.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtggggggaggcttgggtgcaggccggggtgggtccctggccgactctcctgtgctaatttcngaacnccccttacaatcagtgtgatgaatgggccncaggctcgagggagggctgggagtgggtgcaataataaaaagtagactgctaggtagagacaaccagactacgctgctgccttcgagagcaagcttacaccattcttacagagatagaatcaanagagacacttcttagtttcagtacaaagtcgaaacngaccgtagggaaacgcggaccggaacacgacgacctattaggtaactttagttaggtaactagttaacggactaacgttacgtaacggttccccggtagggggacccctaacggggtaaccccgtccgg

SEQ ID NO: 316484 - DNA, 537 bp, Homo sapiens
  misc_feature: GZ8MTXP02HID0Y.2.33.C11.1.454.CMB.2.raw
  modified_base (254)..(254): a, c, t, g, unknown or other
  misc_feature (254)..(254): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactggtggcgtctgggggaggcttggtgcaggccgggtgggtccctgcgactctcctgtgcaatttcngaacgccccttcaatacagtgtggatgaattgggccnccaggcttcgagggagggctgggagtgggttgcctataataaaaagtagactgctggtgagacaaccagactacgctgctgccttnagagcagattcacatctcagagatgaatcaacagagcacttctgtttcngacaaatgaaacncgaccgtaggaaacgcgacggaacacgacgaccagtagttaacttattgtaactagttagactaagtactacgtcccgtagggcccacggtaccctcg

SEQ ID NO: 316485 - DNA, 566 bp, Homo sapiens
  misc_feature: GZ8MTXP02IE0Z1.2.33.C11.1.454.CMB.2.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggttccactgtgagctgcgactggtgcgtctggggagcgttggtgcaggccggtggaccctgcgactctctgtgctaatttctgaagcccccttcaaatacngtgngatgagtcggccncgagcncgagggaggngnggnggtggtgacgataataaaagtaagatgngtgtagagacaacagactacgctgctcgtctacgagagacgagatacactactctacagagatanatacaacgagacgactactacttcgtttcgttagtaactaaacgtaacgaacgacgtacgtaacggaacgacgacgacgaacgacgacgagtagttattaagttacgtactacgttaagtacgtaacgtactacgtaccgtacggtaccgtaccggtaccgtaccg

SEQ ID NO: 316486 - DNA, 570 bp, Homo sapiens
  misc_feature: GZ8MTXP02G914O.2.33.C11.1.454.CMB.2.raw
  modified_base (258)..(258): a, c, t, g, unknown or other
  misc_feature (258)..(258): n is a, c, g, or t
  modified_base (384)..(384): a, c, t, g, unknown or other
  misc_feature (384)..(384): n is a, c, g, or t
  modified_base (431)..(431): a, c, t, g, unknown or other
  misc_feature (431)..(431): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtgggggaggcttggtgcaggccgggtgggtccctgccgactctcctgtgctaatttcngaacgcccccttacaatacagtgtggatgaattgggtccgccaggctccgaggggagggctgggagtgggtggccataataaaaagtagactgctggtgagacaaccagactacgctgctgccttnagaggcagatcacatctcagagatgaatcacagagcactctgtttcngacaaatgaaacagaccgtagggaacgacgacggaacacacgaccagttacgtaatttagttagtaactaagtttaaggaactaacgttaacgtacggttccccggtagggggaccctaacggggtaaccccttcccgg

SEQ ID NO: 316487 - DNA, 536 bp, Homo sapiens
  misc_feature: GZ8MTXP02GLFGR.2.33.C11.1.454.CMB.2.raw
  modified_base (292)..(292): a, c, t, g, unknown or other
  misc_feature (292)..(292): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgccattttaaaaggttccactgtgagctgcgactgggtggcgtcgtgggggaggcttggtgcaggccgggtgggtccctgcgactctcctgtgcaatttctgaacgccccttcaatacagtgtggatgaattgggtccnccaggctccgaggggaagggctgggagtgggttggccataataaaaagtagactgctggtgagacaaaccagactacgctgctgccttcagaggcagattcaccatctcaganatgaatcanagancactcttgttctagacaaatgaacagcctaggaaacgacgcggaacacaacgcatgtattatacgtacagttacgacaatactacgtacccgtggggacccacggggtaaccctccgg

SEQ ID NO: 316488 - DNA, 653 bp, Homo sapiens
  misc_feature: GZ8MTXP02HQ61C.2.33.C11.1.454.CMB.2.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (395)..(395): a, c, t, g, unknown or other
  misc_feature (395)..(395): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctggaggtggtattttccttgctgcctaatttttaaaaggttccatgtgagctgcgacgtgggtggcgtcgtggggggaggtcgttgggtgcgagggcccgggggtgggtcccctggccgactctcctgtgctaatttcagaaccgtccccttacaatacagtgtggatgaagttcgggccncaggctcgaggggagggctgggngtggtgactaataaagtaaaaagtagactgcgtaggtagagaacaacagactacgntgctgccttgaggacgcagtactaccacctatccttcaagaacgtatagaaactccgaaagaagacgtctaaccgttcttcgtttacagtaaactaaaatcgggaaacacgggaccgaaggggaaacgacggaccggaaaccacgaacggacctaattaggttaactttagttacgtaacgtaagtttaacggacttaacgtacgtaaacccggtccccgggtaacgggaccccgtaaacggggtaacccccttccgg

SEQ ID NO: 316489 - DNA, 596 bp, Homo sapiens
  misc_feature: GZ8MTXP02JLODF.2.33.C11.1.454.CMB.2.raw
  modified_base (256)..(256): a, c, t, g, unknown or other
  misc_feature (256)..(256): n is a, c, g, or t
  modified_base (345)..(345): a, c, t, g, unknown or other
  misc_feature (345)..(345): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggttccactgtgagctgcgactggtggcgtcgtgggggaggcttgggtgcaggccgggtgggtccctgcgactctcctgtgcaatttcngaacgccccttcaatacagtgtggatgaatgggtccgcaggctccgagggagggctggagtgggtgcatataaaagtagactgctggtnagacaaccagactacgctgctgccttcaggaggcagattccacatcttcagagatgaatcacagagcactctgtttctgacaaatgaaacagaccgtagggaaagaccggacggaaccaaacgacggacccaagttacgttaacgtttaatttacggttaacctaaagtttaacgggaactaaccgttaagttaaccgggtaccccggttaggggggacccctaacggggggtaaaccccctttcccgggg

SEQ ID NO: 316490 - DNA, 517 bp, Homo sapiens
  misc_feature: GZ8MTXP02IJMOR.2.33.C11.1.454.CMB.2.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgccattttaaaaggttccactgtgagctgcgactggtggcgtctgggggaggcttggtgcaggccgggtgggtccctgcgactctcctgtgcaatttctgaagcccccttcaatacagtgtggatgaattgggtccgccaggctccgagggagggctgggagtggtgccatataaaagtagactgctggtgagacaacagactacgntgcngccttcagaggcagattcaccatcttacagagatgaatcaacagagcactntgtttcagacaaatgaaacngcctggaagacgcggaacacagccatgtattatagtacattaggacaacgtactacgtccgtggggaccacgggaaccctcg

SEQ ID NO: 316491 - DNA, 592 bp, Homo sapiens
  misc_feature: GZ8MTXP02IZSZJ.2.33.C11.1.454.CMB.2.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctaggaaaaccagcctacacgcttaaaccgggacaaccgtcgcccgaccaacatagccttctcccgtcccccttcgcagtaacaccaagtacaggaatattaacctgtttcccatcgactacgcctttcgcctcgccttagggcactcacctgccccattaacgtgacnggaaccctggtctcggngagcggctttcaccgtntttatcgttaccttatgtcagcattcgctacttctgactaccctcancatcgcctcacagcacnccttacacaggctacgaacncctaccccaccaacaaccgcaataacgccgtacgctcgccgacacgtcgttcggtgaccgtagttacggtttaaccgtccccgttttactacttcccgttccccgcctaagttcctaggtacttcggttcgtacg

SEQ ID NO: 316492 - DNA, 586 bp, Homo sapiens
  misc_feature: GZ8MTXP02F3L7Z.2.33.C11.1.454.CMB.2.raw
  modified_base (273)..(273): a, c, t, g, unknown or other
  misc_feature (273)..(273): n is a, c, g, or t
  modified_base (433)..(433): a, c, t, g, unknown or other
  misc_feature (433)..(433): n is a, c, g, or t
  modified_base (534)..(534): a, c, t, g, unknown or other
  misc_feature (534)..(534): n is a, c, g, or t
tcagacgctcgacacacgaccggtgctcgatttagagtgagctcgttggggtttgggagccccagccttgggattcccaagtgttttcattcagtgatcaggactgaacacagaggactcaccatggactttgggctgaggtggatttcctgctgcctattttaaaggttccatgtgagctgcgactgggtggcgtcgtggggggagcttggtgcaggccggggtgggtccctggcgactctcctgtgcatttctgacgccccttccaatacngtgtggatgaagtgggtccgccgaggctccgaaggggaaggggcgtgggaggtgggttggaccaataagtaaaaagtaagctgctggagagacaacagactacgctgctgcctcaggaggcagtatcacattctcgaagagatagaaactcaacaagganacctacttcttgtttctagactaaaatagaaacacgcgtaggaacgcgacgacacacgactagttagtaactttagtagtaaccgtaagttacggtaaacnccgttaaattaccgggtcccggtggggaacccgacggggtaacccctttccg

SEQ ID NO: 316493 - DNA, 623 bp, Homo sapiens
  misc_feature: GZ8MTXP02IJ5B8.2.33.C11.1.454.CMB.2.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (472)..(472): a, c, t, g, unknown or other
  misc_feature (472)..(472): n is a, c, g, or t
tcagacgctcgacacacgaccggtgctcgatttagagtgagctcgttgggtttggggagccccagccttgggattccccaagtgttttcattcagtgatcaggactgaacacagaggactcaccatggactttgggctgaggtggatttcctgctgccattttaaaggttccactgtgagctgcgactgggtggcgtcgtggggggaggcttgggtgcaggccggggtgggtccctgcgactctcctgtgctaatttcngaacgcccccttcaatacagtgtggatgaattgggtccnccaggctccgaggggaaggggctgggagtgggttgaccataagtaaaagtagactgctggtgaagacaacagctacgctgctgccttcgagaggcagtattccacctatctacagagatgaatcaacagacgctaacttcttaggttttacagtaacctaaaagtcgaaaaccncgtacccgtagggaaacgacgaccggaacacgacgaccgtattaggttaactttaagttacgtaacctaaagtttacgggaaactaacgtttaacgtaaccggttccccggtacgggggacccgtaaaccgggggtaaccccctttaccgg

SEQ ID NO: 316494 - DNA, 601 bp, Homo sapiens
  misc_feature: GZ8MTXP02GMB84.2.33.C11.1.454.CMB.2.raw
  modified_base (569)..(569): a, c, t, g, unknown or other
  misc_feature (569)..(569): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttaggggtcgactcaccctgccccgattaacgttggacaggaacccttggtcttccggcgagcgggtcttttcgaccgtctttatcgttaccttatgtcagctattcgctacttctgactacctccagccatcgaccctcacagccaacacccttcaaccagggccttaacggaaaccgccctaccccctaacccaaacaaccgcaataacgcgtacgctcgccacagtccttcggtgctacgttcggtttacgcccccgtttancttcccttcccgctatcctgactcgttcgacg

SEQ ID NO: 316495 - DNA, 583 bp, Homo sapiens
  misc_feature: GZ8MTXP02JRUKK.2.33.C11.1.454.CMB.2.raw
  modified_base (343)..(343): a, c, t, g, unknown or other
  misc_feature (343)..(343): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgccatttaaaggttccactgtgagctgcgactggtggcgtcgtgggggagcttggtgcaggccgggtgggtccctggcgactctcctgtgctaatttctgaacgccccttcaatacagtgtaggatgaatgggtccgccaggctcgagggagggctggagtggtgcagtataaaaagtagactgctggtnagacaacagactacgctgctagccttcagaggcagacttcaccatctacaganatagaatccaanaggacacacctntcgtttcagtacaaagtacgaaacaggacctagggaacgacgacgggaacacgagtaccattacggttaaacttagttagtaaccgtaagtttaacggaactaaccgttaagttaccggtaccccggtgggggacccctaacgggggtaaacccccttccggg

SEQ ID NO: 316496 - DNA, 562 bp, Homo sapiens
  misc_feature: GZ8MTXP02J1JJT.2.33.C11.1.454.CMB.2.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtgattttcctgctgccattttaaaaggttccactgtgagctgcgactggtggcgtctgggggagcttggtncagccgggtggtccctgcgactctcctgtgcaatttcngaacgccccttacaatacagtgtggatgaattgggtccncaggctcgagggaggctggagtggtgcataataaaagagactgctgggtanagacaacngactagctgctgcctcagaggcagacttcacccatccttacgaganatagaaactccgaanagacgtcctacgttcttgtttacagactaaaagtcgaaacgtacgaccgaggaacgaccggacgaccaacgacgtcaattagtaattcgtacgtaactagttacgaactaacgtacgtaccggtcccggtacgggacccgaacggtacccctcg

SEQ ID NO: 316497 - DNA, 544 bp, Homo sapiens
  misc_feature: GZ8MTXP02HQ4EJ.2.33.C11.1.454.CMB.2.raw
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgcctattttaaaaggttccactgtgagctgcgactgggtggcgtcgtggggggaggtcttgggtgcaggccggggtgggtccctgcgactctcctgtgctaatttctgaacgtccccttcaatacagtgnggatgaattgggccncaggctccgagggagggctggagtgggtgcatataaaaagtagactgctggtgagacaaccagactacgctgctgccttcagaggcaagacttcaaccatcttcagagattaaatcacagagcactctgtttctgactaaatagaaacagcctaggaacgacgcggacacgagccatgtattatgtaactagtacgactaactaagtacgtcccgtaggggaccaccggaaccctcgtacccg

SEQ ID NO: 316498 - DNA, 552 bp, Homo sapiens
  misc_feature: GZ8MTXP02GLJQP.2.33.C11.1.454.CMB.2.raw
  modified_base (384)..(384): a, c, t, g, unknown or other
  misc_feature (384)..(384): n is a, c, g, or t
  modified_base (441)..(441): a, c, t, g, unknown or other
  misc_feature (441)..(441): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggtcactcaccctgccccgattaacgttggacaggaacccttggtcttccggcgagcggggcttttcgacccgngttactcgttaccttatgtcagcattcgcacttctgatacctccagcatgctcacancacacctcacagctacgacgctccctacccaaccaacacacaagacgtcgctcgccgcacgctcgtgcatgttcgtcccgttcctactctccgtccactctgactgtcgcg

SEQ ID NO: 316499 - DNA, 588 bp, Homo sapiens
  misc_feature: GZ8MTXP02JX6LB.2.33.C11.1.454.CMB.2.raw
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgatttaacgttggacaggaacccttggtcttccggcgagcgggtcttttcacccgtctttatcgttaccttatgtcagcattcgcacttctgatacctccagcatgcctcacagcacaccttcacaggcttacggaacgcctacccctacccaacaacgcaataacgacgtccgactcgccgccagccttcgggtcgcacgttcggtttacgtcccccgtttctacttttcccgcctactcctgtactcgtcgacgtcg

SEQ ID NO: 316500 - DNA, 538 bp, Homo sapiens
  misc_feature: GZ8MTXP02JJL2P.2.33.C11.1.454.CMB.2.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (404)..(404): a, c, t, g, unknown or other
  misc_feature (404)..(404): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggtttccactgtgagctgcgactggtggcgtcgtgggggaggcttggtgcaggccgggtggtccctgcgactctcctgtgcaatttcngaacgccccttcaatacagtgtggatgaattgggtccnccaggctccgagggaggggctgggagtgggtgccatataaaaagtagactgctggtgagacaacgagactacgctgctgccttcaggagccagattcaccatcttacaganatgaaatcaacagacgacactctgtttctgacaaatcgaaacagcctaggaagacgaggaccacgagccatgttaattagttagtacagttacgactaacgtactacgtcccgaggggaccacgggaccctacg

SEQ ID NO: 316501 - DNA, 527 bp, Homo sapiens
  misc_feature: GZ8MTXP02FX3R6.2.33.C11.1.454.CMB.2.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (394)..(395): a, c, t, g, unknown or other
  misc_feature (394)..(395): n is a, c, g, or t
  modified_base (414)..(414): a, c, t, g, unknown or other
  misc_feature (414)..(414): n is a, c, g, or t
  modified_base (452)..(452): a, c, t, g, unknown or other
  misc_feature (452)..(452): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctaggggaggcttggtgcagccgggtgggtccctgcgactctcctgtgcaatttcngaagccccttcaatacagtgtggatgaattggggtccnccaggctccagggaaggggctgggagtggtggcatataaaagagctgctggtnagacaacagactacgctgctgcctnagagcagattcacatcttcaganngatcacagcgacactcttnttctgataaatgaaacagccgtaggaacgcggcgaacncaagccatgtatttatagtactattaggacctaagtactacggtcccgtaggggacctacggggaacccttccgg

SEQ ID NO: 316502 - DNA, 613 bp, Homo sapiens
  misc_feature: GZ8MTXP02IEPQ2.2.33.C11.1.454.CMB.2.raw
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgccattttaaaaggttccactgtgagctgcgactggtggcgtctggggggaggcttgggtgcaggccgggtgggtccctgcgactctcctgtgcaatttctgaacgcccccttcaaatacagtgtggatgaattgggccgccaggctccgaggggaggggctgggagtgggttggccataagtaaaagtagactgctggtgagacaacagaatacgntgcctgccttcagacggcagattcacctatcttcaganatgaaatcaacagagctacttcttcgtttcctagacctaaaattcgaaaaccacggtacccgtaaggggaacggaaaccggccgggaaaccaccgaacggaccctaattaggtaattttacgttagtaacctaaagtttacggaacctaacgttaattaccggtccccggtagggggacccctaaacgggggtaaccccctcgg

SEQ ID NO: 316503 - DNA, 537 bp, Homo sapiens
  misc_feature: GZ8MTXP02JFX9M.2.33.C11.1.454.CMB.2.raw
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggttccactgtgagctgcgactgggtggcgtcgtgggggagcttggtgcaggccgggtgggtccctgcgactctcctgtgcaatttctgaacgccccttaccaatacagtgtggatgaattgggtccgccaggctccgagggagggctggagtggtgccatataaaaagtagactgctggtgagacaacagactacgctgctgcctcagaggcagatcacatctcagagatgaatcacagagcactntagtttcngactaaatcgaaacagcctaggaagacgcggaacacagccagtagtattaatagtactaagttaggaactaacgtataacgttcccgaggggacccaacggggtaaccctccgg

SEQ ID NO: 316504 - DNA, 608 bp, Homo sapiens
  misc_feature: GZ8MTXP02IZQWH.2.33.C11.1.454.CMB.2.raw
  modified_base (349)..(349): a, c, t, g, unknown or other
  misc_feature (349)..(349): n is a, c, g, or t
  modified_base (407)..(407): a, c, t, g, unknown or other
  misc_feature (407)..(407): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggatttcctgctgccattttaaaaggttccactgtgagctgcgactgggtggcgtcgtgggggagcttggtgcaggccgggtgggtccctgccgaccctctgtgcattctgacgcccttccaatacagtgtggatgaattggtcgcaggctcagggagggctggaggtggtggcatagtaaaagaagactgctgtaggagaactaanacgactacgctgctcgccttcaggacggtcagattcaccaatcttcagagatgaatanacagagcactcttcggtttctacgactaaatacgaaacacgaccgtagggaaacgacggtaacgggacacccaaaggtcccctagtaacggtttattaactttacggtaactaacgtttaagggaacctaacttaaaacgtcggttaacccgttcgggggacccgtaaccggggtaaaaccccgttccgggtttaaccccg

SEQ ID NO: 316505 - DNA, 504 bp, Homo sapiens
  misc_feature: GZ8MTXP02GF4I8.2.33.C11.1.454.CMB.2.raw
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactggtggcgtcgtgggggagcttggtgcagccgggtgggtccctgcgactctcctgtgcaatttcngaacgccccttcaatacagtgtggatgaattgggtccnccaggctccgagggagggctggagtggtgccataataaaaagtagactgctggtgagacaacagactacgctgctgccttnagagcagattcaccatctcagagatgaatcaacagagcatctgttcngacaaatgaacagcctaggaagacgngacacacgcatgtattatgtacatagacaatatacgtccgtggggaccacggaccctcg

SEQ ID NO: 316506 - DNA, 583 bp, Homo sapiens
  misc_feature: GZ8MTXP02IA8MK.2.33.C11.1.454.CMB.2.raw
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgcctattttaaaaggttccactgtgagctgcgactgggtggcgtctggggggaggcttgggngcaggccggggtgggtccctggcgactctcctgtgctaatttctgaacgccccttacaatacagtgtgatgaatgggtccnccaggctccgaggggaagggctgggagtgggttcgacagtaaagtaaaaagtagactgctggtanagacaacagactanctgctgcctgagnggcagacttcacatctnagagatgaatcacagagtcctatcttgttacngtaacaaaagtgaaacnggacctagggaacgaccggagaacacgaacgtccaaagtttgtaaattttactagtaactaagtttaacggaacctaacgtattaaaccggtcccggtaggggaccctaacggggtaaccctccgg

SEQ ID NO: 316507 - DNA, 474 bp, Homo sapiens
  misc_feature: GZ8MTXP02IBMBE.2.33.C11.1.454.CMB.2.raw
  modified_base (460)..(474): a, c, t, g, unknown or other
  misc_feature (460)..(474): n is a, c, g, or t
tcagacgctcgacacacgaccggtgctcgatttagagtgagctcgttgggttggccatataaaaaagtagactgctggtgagacaacagactacgctgctgccttcagaggcagattcaccatcttcagagatgaatcacagagcactctgtttctgcaaatgaacagcctggaagcgcggacacagccatgtattattgtacattaggacactatgtcccgtggggccaggggaacccctcgtcaccgtctcctcacgcctccacccaacgggccccactccggtcccttcccccccgtcgggccgcccctcgcctcccgaggacgccacccctcccgacgacgcaccacggccggccccgtcgggcctcgcccgtcggacgaacggtccttccttcccgtggtccgacgtccgtcgtggacgggcccggggcgtgggaccgacgggccggctagtagnnnnnnnnnnnnnnn

SEQ ID NO: 316508 - DNA, 584 bp, Homo sapiens
  misc_feature: GZ8MTXP02JDLB5.2.33.C11.1.454.CMB.2.raw
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactgggtggcgtcgtggggggagcttgggtgcaggccggggtgggtccctggccgactctcctgtgctaatttcngaacgccccttcaatacagtgtggatgaattgggccnccaggctccgagggaggctggagtggtgcatataaaaagagactgctggtgaagacaaccgagactacgctgcttgccttcaggacggcaagtactttccgacctagtcttacagagatagaatcacagaacnctacttcttgttacacgtactaaagtacgaacacggaccgaaggaacggacgacgaacacgacgactagttagttaacttagttacgtaacgtaacgttaacgaactaacgtacgtaccggtcccggacggggacccgtaaccggtaccctcg

SEQ ID NO: 316509 - DNA, 644 bp, Homo sapiens
  misc_feature: GZ8MTXP02ICROG.2.33.C11.1.454.CMB.2.raw
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggttccactgtgagctgcgactgggtggcgtctggggggaggctttgggngcaggccgggtgggtcccctggcgactctcctgtgctaatttcngaacgccccttcaatacagtgtggatgaattgggccnccgaggctccgagggagggctgggagtggtgcataataaaagtagactgctggtganacaacagactacgctgctgccttcagnggcagacttcaccatctacagagatagaaatcaacaagagacacttcgttcgttttccagtaactaaaagttcgaaaaccgacggacccgtagggaaacgtaacccgggacgggaaaccaacgaaccggacctaaagttacggttaacttttaagttacgttaaacctaaaggttttaacggaaaccttaacgttacgttaaaccggttacccccggttaacgggggaccccgttaaaccgggggtaaacccccttcccggg

SEQ ID NO: 316510 - DNA, 562 bp, Homo sapiens
  misc_feature: GZ8MTXP02J2IKR.2.33.C11.1.454.CMB.2.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
tcagacgctcgacacacgaccggtgctcgatttagagtgagctcgttgggtttgggagaggagccccagccttgggattcccaagtgttttcattcagtgatcaggactgaacacagaggactcaccatggactttgggctgaggtggattttcctgctgccattttaaaaggttccactgtgagctgcgactggtgtcgtctgggggagctttgggtgcaggccgggtgggtcccctgcgactctcctgtgcaatttcnggaacgcccccttcaatacagtgtggatgaattgggtccnccaggctccgaggggaaggggctgggagtgggttgccataataaaaagtagactgctgggtagacgacaacgagactacgcttgctgcccttnagagcagctcaccatctacaganatgaaatcaacagagcagtcttagtttcagcaaaatgaacgacgccgtagggaagaccgacgggacaacgacggacctagttagttaacttagtacgtaactagttaacggactacgtacgtacgtcccggtagggccgaaccggg

SEQ ID NO: 316511 - DNA, 558 bp, Homo sapiens
  misc_feature: GZ8MTXP02HWYJ0.2.33.C11.1.454.CMB.2.raw
  modified_base (260)..(260): a, c, t, g, unknown or other
  misc_feature (260)..(260): n is a, c, g, or t
  modified_base (407)..(407): a, c, t, g, unknown or other
  misc_feature (407)..(407): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtggggggaggcttggtgcaggccggggtgggtcccctgcgactctcctgtgctaatttcngaacgccccttacaatacagtgtggatgaatgggtccgcaggctccgagggagggctgggagtgggtgccataataaaaagtagactgctggtgagacaacagacctacgctgactgccttgagagcagattcaccatcttacaganatagaatcacagacgcaactcttgtttactgtacaaatagaacacgccgtaggaagacgacggacacagccagtgtaattattacgtactaagttaggaactaacgtactaacggtcccgtacggggacccgtacggggtaacccctccgg

SEQ ID NO: 316512 - DNA, 607 bp, Homo sapiens
  misc_feature: GZ8MTXP02JZ3OE.2.33.C11.1.454.CMB.2.raw
  modified_base (404)..(404): a, c, t, g, unknown or other
  misc_feature (404)..(404): n is a, c, g, or t
tcagacgctcgacacacgaccggtgctcgatttagagtgagctcgttgggtttggagagccccagccttgggattcccaagtgttttcattcagtgatcaggactgaacacagaggactcaccatggactttgggctgaggtggattttccttgctgcctaattttaaaaggttccactgtgagctgcgactgggtggcgtcgtggggggaggcttgggtgcgaggccggggtcgggtccctgcgactcctcctgtgctaatttctgaacgtccccttacaatacagtgtggatgaattcgggtccgccaggctaccgaggggaagggcgtggaggtgggttggaccaataaagtaaaaagtagactggctgggagaagaccaacagactacgctgctgccttnaggagcagtattccacctatctacagagatagaactcaacagagactacttcttgtttacagactaaagtagaacacggaccgtaggaaacgaccggaccgaacaacgtacgacctagtacgttaattagttacgtaaactagtttaacggaactacgtaagtacccggttaccgtacgggggaccgtaacgggtaacccccg

SEQ ID NO: 316513 - DNA, 711 bp, Homo sapiens
  misc_feature: GZ8MTXP02GGOT2.2.33.C11.1.454.CMB.2.raw
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
tcagacgctcgacacacgaccggtgctcgatttagagtgagctcgttgggtttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaagggctggagtgggttgcatataaaagtagactgctggtgagacaacagactacgctgctgcctnagaggcagacttcaccatcttacagagatgaatcaacagagcacctctgtttcngacaaatcgaacacgcctagggaaacgaccggacggaacaaccgacgacccaagttagttaaatttagtttaagttaacctaaagttttaacgggaaaccttaaacttaaacgttaaccgggttaccccggtttacggggggaccccgtaaaccgggggtaaacccccgttaccggttaccccgtaaaccccggttccccttacccgtaccgtaccggaccccttaccccgaaacccggaaaaccggggccccctaacggttccccggttaccccgtttccccccgtcggggcccctacccccgtccgtcccgtacccgaacggtacccgaccgaccccgtccggaacgaccggacaacccggg

SEQ ID NO: 316514 - DNA, 581 bp, Homo sapiens
  misc_feature: GZ8MTXP02G0BXI.2.33.C11.1.454.CMB.2.raw
  modified_base (379)..(379): a, c, t, g, unknown or other
  misc_feature (379)..(379): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgtggacaggaacccttggcttccggcgagcgggcttttcacccgntttatcgttaccttatgtcagcattcgcacttctgactacctcagcatgccctcacagcacaccttcacacggcttaacggaaacgcctaccccctaacccaaacaacgcaataaacgccgtcgacctgcccgcagccttcgggtgctacgtggtttacgccccgtttcacttccttccccgccatcctggactcgtcgacg

SEQ ID NO: 316515 - DNA, 668 bp, Homo sapiens
  misc_feature: GZ8MTXP02H6P17.2.33.C11.1.454.CMB.2.raw
  modified_base (180)..(180): a, c, t, g, unknown or other
  misc_feature (180)..(180): n is a, c, g, or t
  modified_base (385)..(385): a, c, t, g, unknown or other
  misc_feature (385)..(385): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaaccgggacaaccgtcgcccggccaacatagccttctcccgtccccccttgcagtaacaccaagtacagaatattaacctgttcccatcgactacgtcctttcggcctcgccttaggggtcactcaccctgccccgattaacgtggacaggacccttggtcttccggcgaggcgggtctttccgacccgtntttatcgttacttatgtcagctattccgctacttctagtactaccctcagctatcgccctacacacgcctaacctacccttcaaccgacggtaccttacggaaacccgtcccctaccccctaaaccccaaacgtaaaccgactaaacgtaaaccggtccgtccgccgttacgccccggactacggtcccgtttgggtcgtacctagtttccgggtttaaccctccccgttttacacctttcccgttccccgtacctcgttcctaggtaccttggttcggacgg

SEQ ID NO: 316516 - DNA, 565 bp, Homo sapiens
  misc_feature: GZ8MTXP02FR94J.2.33.C11.1.454.CMB.2.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggatttcctgctgcctatttaaaggttccatgtgagctgcgactgggtggcgtcgtggggggagcttggngcaggccggggtggtccctgcgactctctgtgcaatttcngaacncccccttanaatacagtgtggatgaattgggccncaggctcgagggagggctggngtggtgcatanaaaagtanactgctggnagacaacagactacgctgctgccttnaggagcagacttcacctatcttacagagatagaatcaacagagacacttcttgttctagactaaatagaaactacgccgtagggaacgacggacggaacacgagacctattacgtaacttagttagtaactaagttacggaactaacgttaacgtaaccggttccccggtaggggacccgaacggggtaaccccttccgg

SEQ ID NO: 316517 - DNA, 554 bp, Homo sapiens
  misc_feature: GZ8MTXP02JFC0K.2.33.C11.1.454.CMB.2.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggtttccactgtgagctgcgactggtggcgtcgtgggggagcttggtgcaggccgggtgggtccctgcgactctcctgtgcaatttcngaacgccccttcaatacagtgtggatgaattcgggtccnccaggctccgaggggaagggctggaggtgggtggccataataaaaagtagactgctggtgagacaacagactacgctgctncctnagaggcagacttcaccatcttcagtagatgaaatcgacaganacacttcgtagtttctagacctaaaagtcgaaaacncgacctagggaaagaccgacggacacgaacgcctaagtgtaacttatacgtactagttagacaactatacgtcccgtaggcctacggggaaccctcg

SEQ ID NO: 316518 - DNA, 545 bp, Homo sapiens
  misc_feature: GZ8MTXP02HQ83D.2.33.C11.1.454.CMB.2.raw
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (517)..(517): a, c, t, g, unknown or other
  misc_feature (517)..(517): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactgggtggcgtcgtgggggagcttggtgcaggccgggtgggtccctgcgactctcctgtgcaatttcngaacgccccttcaatacagtgtgatgaattgggtccncaggctcagggagggctggagtgggtgcatataaaaagtagactgctggtgagacaacagactacgctgctgccttnagngcagatcacatctcagagntagaatcaacagancactctatttctagacaaatgaaacacgccgtaggaaacgacgacggaacacgacgccaagttacgtattattagtacctaagttacggactaaccgtatacggttccccgnggggaccctacggggtaaccccttccgg

SEQ ID NO: 316519 - DNA, 684 bp, Homo sapiens
  misc_feature: GZ8MTXP02HN8SG.2.33.C11.1.454.CMB.2.raw
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatacgccttctccgtcccccttcgcagtaacacaagtacagatattactgttccatcactacnccttcgcctcgcctagggcactcaccctgccccgattaacgtggacacggaacccttggtcttccggngacggcgggtctttcgaccgtntttactcgttacttatgtcagctattcgctacttcncgtactaccctcagcatcgacctnactacgctacctccgttacaacgtacggtaccttaaccggaaaccgtccccttaccccgtaaacccaaaccaaacccggactaaacgttaaacggccttaccggcctacgggccccgtacgacgttcccgtttacgggtcgtaccgtaacggtttaccgggtttaacccgtcccccggttttactaaccctttccccgttcccggtacccttaacgtttccgtcggttaacgtccgggtttaccgacggggg

SEQ ID NO: 316520 - DNA, 585 bp, Homo sapiens
  misc_feature: GZ8MTXP02GF8O5.2.33.C11.1.454.CMB.2.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgcctattttaaaaggttccatgtgagctgcgactgggtggcgtcgtggggggagcttggtgcaggccgggtgggtccctgcgactctcctgtgctaatttcngaacgtcccccttcaatacagtgtggatgaattgggtccncgaggctccgaaggggaggggctgggagtgggttgccaataataaaaagtagactgctggnaagacaacagactacgctgctgcctnagagcagtactcactatctcaganatagaatcacaganactacttcttgtttcngacaaatacggaacagaccgtagggaacgacggacggaacacgacgtaccattaggttactttattggttaactagttaacggtaacctaagttaacgtaacggttccccggacgggggtaccctaaccggggtaacccttacccgg

SEQ ID NO: 316521 - DNA, 577 bp, Homo sapiens
  misc_feature: GZ8MTXP02H5C3A.2.33.C11.1.454.CMB.2.raw
  modified_base (298)..(298): a, c, t, g, unknown or other
  misc_feature (298)..(298): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggttccactgtgagctgcgactgggtggcgtcgtgggggaggcttgggtgcaggccgggtgggtccctgcgactctcctgtgctaatttctgaacgtccccttacaatacagtgtggatgattgggtccncaggctcgagggagggctgggagtgggtgcataataaaaagtagactgctagggtgaagacaacagactacgctagctgccttcgagtacgggcaagtacttaccacctaatcttacgagagtatagaaatcaacgagaagctaactcttcgttttctaggactaaaatgaaactagaccgtaggaaacggacgacggacacgacgccagttagtattagtacgtacagttagactaacgtactacgtcccggagggacccaacggggtaaccctccgg

SEQ ID NO: 316522 - DNA, 567 bp, Homo sapiens
  misc_feature: GZ8MTXP02G8GUV.2.33.C11.1.454.CMB.2.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggatttctgctgccattttaaaaggttccactgtgagctgcgactggtggcgtcgtgggggaggcttggtgcaggccgggtgggtccctgcgactctcctgtgcaatttcngaacgccccttcaatcagtgtggatgaattgggccncaggctcgagggagggctgggagtgggtgcataataaaagtagactgcgtggtgaagacaaacagactagctgcctgccttnagaggcagacttcaacctatcttcgaagagatagaaatcaacagagcctaacttctggtttacngtaccaaagtcgaaacncgaccgtaggaaacgcggacggacacgacgaccagtgtactttaattcgtaacgtaattacggaactaacgttaagtaccggttcccgaggggtaccgaaccggtaaccctccgg

SEQ ID NO: 316523 - DNA, 599 bp, Homo sapiens
  misc_feature: GZ8MTXP02GA9W7.2.33.C11.1.454.CMB.2.raw
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggcactcaccctgccccgattaacgtggacaggacccttggtctcggcgagcggcttttcaccgtntttactcgttacttangtcagtcattcgctacttctagactaccctcagcatcgcctcacagccacaccttcacgacggtacttaacacgaaacctccctaccccctaacccaaacaaccgcaacgtaacgccgtcgcgtcgccgcacgtcttcggactcgtacgttcggtttaccgtaccccgtttcaccttccgttccccgctactctcgtactcgtacg

SEQ ID NO: 316524 - DNA, 636 bp, Homo sapiens
  misc_feature: GZ8MTXP02HI9CZ.2.33.C11.1.454.CMB.2.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (441)..(441): a, c, t, g, unknown or other
  misc_feature (441)..(441): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgcctattttaaaaggtttccactgtgagctgcgactgggtggcgtcgtggggggaggcttggtgcaggccggggtgggtccctggcgactctctgtgctaatttctgaacgtcccccttaccaaatacaggtgtggatgaagttcgggtcccncgaggctccgaggggagggctgggagtggtgcaataataaaagagacngctaggngaagacaacgagactacgctgctgccttacgagaggcaggtattccaccagttcgttacggagatagaatacacaganacacttcttgtttacagtacctaaaagtcgaaacgacgaaccgtaggaaacggacggacggaaccacgaacggccctaataggttacttaagtttacgtaaaccgttaagtttaaccggaacttaacgtaaacgttaccggtaccccggttacgggggacccgtaacccgggtaaaccccgttccggtaaccccg

SEQ ID NO: 316525 - DNA, 552 bp, Homo sapiens
  misc_feature: GZ8MTXP02JLUVJ.2.33.C11.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtgatttcctgctgcctattttaaaaggttccactgtgagctgcgactgggtggcgtcgtgggggagcttggtgcaggccgggtgggtccctggcgactctcctgtgctaatttcngaacgccccttacaaatacagtgtggatgaattgggtccnccaggctccgagggagggcnggagtggtgccagtaataaaagtagctgctggtgagacaacgagactacgctgctgccttcagtaggcagacttcgacctatctacagagatagaatcacagagactactcttgttactgacaaatgaaacacgccgtaaggaagacggacggaacacgacgactattagtaattagtacgtacagttaggactaacgtatacggtccgtacggggacctaacgggaaccctccgg

SEQ ID NO: 316526 - DNA, 654 bp, Homo sapiens
  misc_feature: GZ8MTXP02G2OHP.2.33.C11.1.454.CMB.2.raw
  modified_base (314)..(314): a, c, t, g, unknown or other
  misc_feature (314)..(314): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtgattttcctgctgcctattttaaaaggttccactgtgagctgcgactgggtggcgtcgtggggggagtcgttgggtgcaggccggggttgggtcccctggccgtactctccgtgtgctaatttcagaaccgtcccccttacaatacagttgtggatgaaagttcggggtcccncgaaggcctaccgaaggggaaggggctaggggacggttggggttacggaccctaagttaaaagtaaaaaaaggtagtaacctggacgttaggtagaaggtaacaaccgagactacgcgtagcttcgccttacgaggcggacagtactaccacatctacgagagatagaactcaacgagtacgactacgttcttaggtttccaggaacctaaagtacgaaacacggtaccgaagggaacgacgacggaacacgacgtcctaatagttaattacttaagtacctagttaacgacaacgttacgtaaccggtccgtagggacccgtaacggtacccctaccgg

SEQ ID NO: 316527 - DNA, 565 bp, Homo sapiens
  misc_feature: GZ8MTXP02F00EG.2.33.C11.1.454.CMB.2.raw
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggatttcctgctgccatttaaaaggttccatgtgagctgcgactgggtggcgtctggggggagcttggngcaggccgggtgggtccctgcgactctcctgtgcaaatttcngaaagcccccttacaaatacagtgtggatgaattgggtcnccaggctccaggaagggctggagtgggtggccatataaaaaagtaagactgctggtgagacaaccagactagctgctgccttnagagcagtatcactatctnaganatanaatacacagagacactcttcgtttctgacaaaataagaaacaacgacgtaggaaacggaacggacggaacgaacaacgaccatattaatttaattagttaacgtaataagtaacaactaacgtaacgtaccggtacgggaccggaaccgggaacccgtaccg

SEQ ID NO: 316528 - DNA, 567 bp, Homo sapiens
  misc_feature: GZ8MTXP02F8ZN4.2.33.C11.1.454.CMB.2.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactggtggcgtcgtggggggaggcttggtgcaggccggggtgggtccctgcgactctcctgtgcaatttcngaacgccccttcaatacngtgtggatgaattgggtcccgcaggctccgagggaggggctgggagtgggttggccatataaaaagtagactggctggngagacaacagactgctnactgccttcagaggcagattcacatcttcagagatgaatcacaganactactcgttatttcngacaaatgaaacngcctaggaagacgcggacacgtacgccattgtaacttagttactactaaagtttacggaacctaacgttaacgttaaccgtcccggtacgggggacccaacgggggtaaacccctttccgg

SEQ ID NO: 316529 - DNA, 585 bp, Homo sapiens
  misc_feature: GZ8MTXP02IWKSU.2.33.C11.1.454.CMB.2.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccatgtgagctgcgactgggtggcgtcgtggggggagcgttgggtgcgaggccggggtgggtccctggcgactctcctgtgactaatttcagaacgtcccccttacaatacagtgtggatgaattgggtccncaggctccgaggggagggctgggagtggtgaccataataaaaagtagatgctggngagacaacagactacgctgctgccttnagaggcagactcacatctacaganatagaatcaanagacgcaacttnttcgtttacacgtanaaaagtcgaaacacgtaccgtaggaacgacggacgacaacgacgaccattagttaactttagttagtaactaagttaacggaactaacgttagtaaccggtacccggtacggggacccgtaacgggtacccctaccgg

SEQ ID NO: 316530 - DNA, 699 bp, Homo sapiens
  misc_feature: GZ8MTXP02IRT5S.2.33.C11.1.454.CMB.2.raw
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
  modified_base (440)..(440): a, c, t, g, unknown or other
  misc_feature (440)..(440): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgccttcggcctcgccttagggtccactccaccctgccccgattaacgtggacacggaaccctggtcttccggcgagcgggtctttcgacccgtnttatcgttacttatntcagtctattcgctacttctagactacctcagcatgcctcacngaccactaccttcaacgtcggtaccgttaaccgggaaacctccccgttacccccaaccctaaacctaacccgacaaacgtaacgtcccggttaccggccttacggaccccgtacgtacggtcccgtttccggggtcgtaccttaaacggtttccggggttttaaaccgtccccccggttttaactaccgttaccccgtttccccccggaccttaaccggttcccttaagggttaccctttacgggttcccggtaaccgg

SEQ ID NO: 316531 - DNA, 646 bp, Homo sapiens
  misc_feature: GZ8MTXP02GLC2I.2.33.C11.1.454.CMB.2.raw
  modified_base (180)..(180): a, c, t, g, unknown or other
  misc_feature (180)..(180): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctcccgtcccccttcgcagtaacaccaagtacagaatattaacctgttccatcgactcgccttcggcctcgccgttaggggtcactccaccctgccccgtattaacgtggacacggaacccttggtcttccggcgacggcgggtcttttccgacccgtctttactcgttaacctatgtcagctattcgcctacttctgactaccctcgagcatcgtccctcactacgcctaacctacccttacacgtacgggtaccttaaaccgggaacccgtacccttaccccctaacccaaacaccgaccaactaaccgccgtcgccgtcgccgacgtacgtccgttcggtcgacttacggttcggttaccgttccccgtttcacttcccgttaacccgctacttccgtagtcgttcgtcgtacgg

SEQ ID NO: 316532 - DNA, 653 bp, Homo sapiens
  misc_feature: GZ8MTXP02JTPD1.2.33.C11.1.454.CMB.2.raw
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcagtaacaccaagtacaggaatattaacctgttcccatcgactacgcctttcggcctcgcctcaggggtcactcaccctgccccattacgtggacaggaaccctggtctccggngacgcggtctttcgacccgntttancccgtttactatgtcagcattcgctacttctgacttaccctcagtcattcgccctacacacgccaactacccttacaccaggtccttaaacgggaaccctcctacccccctaaccaaaccaccgactaacgtaaacggccgttacggcttcggacccggtcaacggttcctttcggggacgtaccgtaacgtttcgggtttaaccgtcccccggttttcaaccgtttccttacccccggacctacttccgttacgaacgttcgtaacccggg

SEQ ID NO: 316533 - DNA, 673 bp, Homo sapiens
  misc_feature: GZ8MTXP02HQG63.2.33.C11.1.454.CMB.2.raw
  modified_base (306)..(306): a, c, t, g, unknown or other
  misc_feature (306)..(306): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggtattttccttgctgcctattttaaaaggttccactgtgagctgcgacgtggtggcgtcgtgggggagtcgttgggtgcgagggccgggggtgggtccctgccgactcctcctgtgctaatttcagactccccttacaatacagtgtagatgaattcgggtccncgaggcctccgaggggaggggctgggagtggggtcgacaataaagtaaaaagtagactggtcgtggtagagaaccaaacgagacctacgctgcctacgccttacgagacggctaagtactttacccaacctattccttacgaagaggtaataacgaaactacaacgacgaacgactaacttcgttcgtttcgacgaactaaagtacgaaacacgtaccggtaaggaaacgaccggacggaaccaacgacgtaccgtaagttggtttaactttagttacgttaactagtttaaaccggacttaaccgttaacgtacccggggttacccggtacgggggtacccgtaaacccgggtaaccccgtcccgg

SEQ ID NO: 316534 - DNA, 795 bp, Homo sapiens
  misc_feature: GZ8MTXP02GFY6Y.2.33.C11.1.454.CMB.2.raw
tcagacgctcgacacacgaccggtgctcgatttagagtgagctcgttgggtttggggagcccccagccttgggattcccaagtgttttcattcagtgatcaggactgaacacagaggactcaccatggactttgggctgaggtggtattttcctgctgcctattttaaaaggttccactgtgagctgcgactgggtggcgtcgtggggggagtcgttgggtgcgaggccgggggttcgggtcccctggccgtacttcctccgtgtgacttaatttcgtagaaccgtcccccttacaatactagtgtaggatgtaagttcgggtcccgcgaggcctaccggaaggggaggggtcgtggggaggttggggttcggacctaagttaaagtaaaaaaggtagtacgtggtcgtagggtagaagaacgaaaccgagaacctacgacttgaccgtcgtccgttacgaaggtacgggaccaaggtaacttacctaaaccctactttaccgttacgaagtaaggtaatacgtaaactcaaacgaaggacgtacctacttaccgtttgtttacgtacgtaaactaaaacgttacggaaacaaccggttacccggtaaagggaaacccgggaacggacccggaaacgaccgaaacggtacccttaagttacggtttaaacgtttaaatttaacgggttaaacctaaaggtttaaaccggaaaccttaaaccgttaacgttaacccgggtttaccccgggaccgggggtaaccccggtaaccgggggtaacccctttaaccccggg

SEQ ID NO: 316535 - DNA, 600 bp, Homo sapiens
  misc_feature: GZ8MTXP02J16KH.2.33.C11.1.454.CMB.2.raw
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
  modified_base (559)..(559): a, c, t, g, unknown or other
  misc_feature (559)..(559): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtccccccttgcagtaacaccaagtacagaatattaacctgttcccatcgactacgcctttcggcctcgccgttaggggtcactccacccctgccccgtattaacgttggacacggtaacccttggtcttccggcgagccgggtctttcgaccgtctttatcgttactatgtcagcacttcgcacttctgactcctcagcattcgcctcacncgcactaccttcgactacggcttaacggaaccgcctacccccaaccaacaaccgacactaacgccgtcncgtcgccgancgtcttcggcncagttccggttcgtcccccgtttacnccgttcccttccccgctactcgtacgtacgtcgtcgtacgg

SEQ ID NO: 316536 - DNA, 612 bp, Homo sapiens
  misc_feature: GZ8MTXP02GA1LW.2.33.C11.1.454.CMB.2.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (463)..(463): a, c, t, g, unknown or other
  misc_feature (463)..(463): n is a, c, g, or t
tcagacgctcgacacacgaccggtgctcgatttagagtgagctcgttgggtttgggagaggagccccagccttgggattcccaagtgttttcattcagtgatcaggactgaacacagaggactcaccatggactttgggctgaggtggattttcctgctgcctattttaaaaggtttccactgtgagctgcgactgggtggcgtcgtggggggagtcttgggtgcaggccgggtgggtccctgcgactctcctgtgctaatttcngaacgtccccttacaatacagtgngatgaattgggccncagctcgagggagggctggagtgggtgactaataaataaaaagtagacgtgcgtgggtanaagaacaacgagactacgctgctcgcttcgagaggacagtactacaacctntacttacgagtaagattacgaaatacaaacgaagacaccttaacccgtntttcggtttacctggaaactaaaagtcgaaaactacgtaccctaaggtaaacggaacgaccggaacacgacgacctagttagtactttattagtactaagtaacggactaacgtaacgtaccgtaccggtacgggaccgtaaacccggg

SEQ ID NO: 316537 - DNA, 579 bp, Homo sapiens
  misc_feature: GZ8MTXP02F650T.2.33.C11.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (451)..(451): a, c, t, g, unknown or other
  misc_feature (451)..(451): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgcctattttaaaaggttccatgtgagctgcgactggtggcgtcgtgggggagcttggtgcaggccggggtggtccctgcgactctctgtgctaatttcngaacgcccccttacaatacagtgtggatgaattgggccncaggcctcgagggaggctggaggtgggttgcaagtaataaaaagtagactgctaggnagacaacgagactagctgctgcctnagagcagatccacctatctacagagatagaatccgaacagacgacacttcttgtttcctgaaccaaatacggaaacngacccgtaggaaacgacgaggaaccacgacaccgtattgttaaattagttagtaacgttaactacggtaaactaacgtaagttaaccgtccccggtaggggacccgtaaccggggtaaccccttccgg

SEQ ID NO: 316538 - DNA, 599 bp, Homo sapiens
  misc_feature: GZ8MTXP02I0J7F.2.33.C11.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtggattttcctgctgccattttaaaaggttccactgtgagctgcgactggtggcgtcgtggggggagcttggtgcaggccgggtgggtccctgcgactctcctgtgctaatttcngaacgcccccttcaaatacagtgtggatgaattgggtcccncaggctccgaggggagggntgggagtggtgacagtaataaaagagntgctggtagagacaacgagactacgctgctgccttcagaggcagactttacacatctacagagatagaatcgaacagagcctacttacgttcgttttactacgactaaaatcgaaaaccgtacgccgtaagggaacggaacggccggaaacacgaacgaccgtaagttagttactttaaagttgtaacgttaacttaagggtactaacgttacgttacgtacccggtcggggacccgacggggtaaaccccttcgg

SEQ ID NO: 316539 - DNA, 635 bp, Homo sapiens
  misc_feature: GZ8MTXP02IZUWI.2.33.C11.1.454.CMB.2.raw
  modified_base (181)..(181): a, c, t, g, unknown or other
  misc_feature (181)..(181): n is a, c, g, or t
  modified_base (367)..(367): a, c, t, g, unknown or other
  misc_feature (367)..(367): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
  modified_base (598)..(598): a, c, t, g, unknown or other
  misc_feature (598)..(598): n is a, c, g, or t
  modified_base (628)..(628): a, c, t, g, unknown or other
  misc_feature (628)..(628): n is a, c, g, or t
tcagacgctcgacacacgaccggtgctcgatttagagtgagctcgttggggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttctcccgtccccccttgcagtaacaccaagtacagaatacttaacctgttcccatcgactacgccttcggcctcgccttaggggtcacctccaccctcgcccctatttaacgtggacaggtaacccttggtctccggngacgtcggtctttccgaccgtctttagtcgttacttatcgtcacgctacttcgctacttctagtactaccctcagccatcgccctnacgacncaactccttacacgacggtacttacgaacgaaccctccctaccccctaacccgaaccaacgaccaaacgtacgccgttcgccgtcgaccgcgtacgtccgttacggcgtacgtacggttcggtttaccgtccccgtttntaaccttcccttacccgctatccgtacgtntcggtcg

SEQ ID NO: 316540 - DNA, 631 bp, Homo sapiens
  misc_feature: GZ8MTXP02JKN65.2.33.C11.1.454.CMB.2.raw
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtgattttcctgctgcctattttaaaaggttccactgtgagctgcgactggtggcgtcgtgggggagcttggtgcaggccggggtgggtccctggccgactctcctgtgactaatttctagaacgtccccttacaatacagtgtggatgaagttgggccgccaggctaccgaggggaacggggctggggacggtggggttggaccgaagttaaagtaaaaaaggtaacgactaggcgtaggggtagaagaaccaaacaggaacctacggctgctcgccttacgagacggaccaagactttacacctatcctacaagngatagaatcaacaaganccgtacttactgtttacacgacaaaagtgaaactagaccctagggaacgacggacggaacacacgacctagtagttaacgttaattacggtaataacttaacggaactaacgtagttaaccgtccggtagggacccgtaacggggtaaccctaccgg

SEQ ID NO: 316541 - DNA, 740 bp, Homo sapiens
  misc_feature: GZ8MTXP02HQGG8.2.33.C11.1.454.CMB.2.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagacgctcgacacacgaccggtgctcgatttagagtgagctcgttgggtttggggagcccccagccttgggattcccaagtgttttcattcagtgatcaggactgaacacagaggactcaccatggactttgggctgaggtggattttcctgctgcctattttaaaaggttccactgtgagctgcgactggtggcgtcgtggggagtcttggtgcgaggccgggtggtccctgcgactctctgtgctaattcngaacgccccttacaatacngtgngatgaattggccncgagcncgaggggaggntgggagtggtgacaagtaaagtaaaagtagactgcgtaggtagacgaaccaacgagacctacgcttggacctgtccttacgaagcgtacctaagtacttccgaaacctattcccttaagagtaacggtattaacgaaacttccgaaacgtacggtacgtacccgttaactttccgttttacgttttaccgaaacgttaaccgtaaaaacgttccgggaaaaacccttacgggaaacccgttaagggggaaaacgtaccccggggaaaccgtaaacccgtaaacggaaccgtaaccttaaaggttttaggttaactttttaaaacggttacgtaaaccggtttaaagttaaccggtaaacttaaccgtttaaacgtacccgggttaccccgggaacggggtaccccggtaaaacggggttacccccttcccgg

SEQ ID NO: 316542 - DNA, 657 bp, Homo sapiens
  misc_feature: GZ8MTXP02JXORR.2.33.C11.1.454.CMB.2.raw
  modified_base (476)..(476): a, c, t, g, unknown or other
  misc_feature (476)..(476): n is a, c, g, or t
  modified_base (578)..(578): a, c, t, g, unknown or other
  misc_feature (578)..(578): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccgccaacatacgccttcctcccgtcccccttgcacgtaacacaagtacaggaatacttaactgttccatcgactacgcctttcgcctcgcgttagggtcactccaccctcgccccgtagtttaacgtggacacggtaacccttggtccttccggcgacggtccgggtcctttccgacccgtctttactcgtttaccttagtcgtcagtctacgtttcgcttaccttctcgtactacccgtccagtccacttcgccctacacncgaccacctccgttacacgtcgtacttacgacaaccgtccctacccccaacaactaaccgactaacacgtccgtacgcgtcgacccgcgacgtccgttcggngtccgtaagtttccggttacccgttccccgtttactacccttcccgtccccgtctacttcgtcgtacgtcgttacccgg

SEQ ID NO: 316543 - DNA, 618 bp, Homo sapiens
  misc_feature: GZ8MTXP02GD0PH.2.33.C11.1.454.CMB.2.raw
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctaggaaaaccagcctacacgaccttaaaccgggacaaccgtcgcccggaccaacatacgccttctcccgtcccccttcgcaagtacaccaagtacaggaatattaacctgttcccatcgactacgcctttcgcctcgcgttagggtcactccaccctcgccccgatttaacgtgacacggtacctggtcttcggcgagccggtctttccgaccgtcttatcgttaccttatgtcatcgtattcgcacttctcgtactacctcgaagcctatctaccctacaccgatccctacctaaccgttcctaacgtacggtacttacgacgtaacccgcctacccctaaccaacaacgtcaagtaaccgcgtacgccgtacgaccgacgtacgtcgtcgttgcgttacgtacgtttcctaccgttcacgttcctccgctacgtcngtacngtcg

SEQ ID NO: 316544 - DNA, 572 bp, Homo sapiens
  misc_feature: GZ8MTXP02FTN7J.2.33.C11.1.454.CMB.2.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
tcagacgctcgacacacgaccggtgctcgatttagagtgagctcgttgggtttggggagccccagccttgggattcccaagtgttttcattcagtgatcaggactgaacacagaggactcaccatggactttgggctgaggtgtattttctgctgcctattttaaaaggttccatgtgagctgcgactgggtggcgtcgtggggggagtcgttggtgcgaggccgggttggtccctgcgacttctcctgtgactaatttcagaacgtccccttacaatacagtgtgatgaagttggccncaggctacgagggaggntgggagtggttgacaataataaaaagtagactgacgtgganaagacaacagactacgctgacctgcctacgagtacgctaagactttaccacctagtcttacgagtagattagaactcaanagacactacttcgttnttacagtacaaatacgaanacgcgagaagacgcgaacacgtacgactagtaagtattaattacgtactaagtagaactaagtaacgtacgtaccggtaggaccgacggtacccgtaccg

SEQ ID NO: 316545 - DNA, 653 bp, Homo sapiens
  misc_feature: GZ8MTXP02I5P1Q.2.33.C11.1.454.CMB.2.raw
  modified_base (180)..(180): a, c, t, g, unknown or other
  misc_feature (180)..(180): n is a, c, g, or t
  modified_base (448)..(448): a, c, t, g, unknown or other
  misc_feature (448)..(448): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaaacatacgccttctcccgtccccccttgccagtaacaccaagtacaggaatattaacctgttcccatcgactacgccttcggcctcgccgttagggtcactccaccctcgccccgtattaacgtggacaggaaccccttggtcctccggcgagtcggtctttcgaccgtcttatcttacttatgtcagctattcgctacttcagactacctcagcatcgcctacacgacnctactacctacacgacgtaccgtaaccgaaccgtcccctaaccccctaacccaaaccgaaccgactaaacgtaacgtccgtacgccgtaccgccgactacgttccgttacggtcgtaccgtacggtttcggtttacccgttaccccgtttactacctttccccgttcccgtacgttacttacggttagtacgttacggtcgtacg

SEQ ID NO: 316546 - DNA, 777 bp, Homo sapiens
  misc_feature: GZ8MTXP02HGJ5X.2.33.C11.1.454.CMB.2.raw
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
tcagacgctcgacacacgaccggtgctcgatttagagtgagctcgtgggagaggagccccagccttgggattcccaagtgttttcattcagtgatcaggactgaacacagaggactcaccatggactttgggctgaggtggtattttccttgctgcctaattttaaaaggttccactgtgagctgcgacgtgggtggcgttcggtgggggagtcgttgggtgcgacgggccggggtgggtccctggccgtactcttccgtgtcgtactaatttcgtagaaccgtcccctttacgaaatcgagttgngggtaatggaacgtttcggggaccccncgagggcctaccggaaggggtaggggctggggtacggttggggtacgcctaaaagttaaagtaaaaaagtagacgtgtacggttgggtaacggaagaaccccaaacgacgtaaccgtaaccggctaggccttcggcccttaagacggtaggctaaggacttaccactattcctaanaggtanagtcgaataccaacgaacggactacctagtttaccgttcgttttacgacgaaccgtaaaaggtacgtaaacccgaacgggttacccgtaaaggggaaacgtaacccgggaccgggtaaaacaaccccggtagggtaaccccttaggtttaaacgttaagttaaacggttacttaaaacccgtaaggtttaaacggaaacctaaccggttacgttacccgggtccggtaacgggggaaccccgtacccgggggttaaaccccc

SEQ ID NO: 316547 - DNA, 592 bp, Homo sapiens
  misc_feature: GZ8MTXP02JN0B9.2.33.C11.1.454.CMB.2.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagacgctcgacacacgaccggtgctcgatttagagtgagctcgttgggtttgggagccccagccttgggattcccaagtgttttcattcagtgatcaggactgaacacagaggactcaccatggactttgggctgaggtggattttcctgctgccattttaaaaggttccactgtgagctgcgactggtggcgtctgggggagcttggtgcaggccgggtggtccctgcgactctcctgtgcaatttctgaagcccccttacaatacagtgtaggatgaattgggcccgctaggcctccgaggggaagggctggacgtgggtggccaataacgtaaaaagtagactgctggtgagacaacngactacgntagctgcctnagagcagatcaccatcgttacnacgatgaatcaacnggaacnctacttcttcgttacncgaacaaagtacgaaccacggaccgtagggaaacgaccggaaccgaacacgaacgtactacgttagttaacttacgttacgtaactacggttaacgtaacctaacgtaacgtaccggtacccggtacgggtacccgaaccgggtaaccctacg

SEQ ID NO: 316548 - DNA, 725 bp, Homo sapiens
  misc_feature: GZ8MTXP02FWINW.2.33.C11.1.454.CMB.2.raw
  modified_base (372)..(372): a, c, t, g, unknown or other
  misc_feature (372)..(372): n is a, c, g, or t
tcagacgctcgacacacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggaccaaccgtcgccccggccaacatagccttctccgtccccccttcgcagtaacactaagtacagaatattaacctgttcccatcgactacgtccttcgcctcgccttagggtcactcaccctcgccccgattaacgttggacagtaacctggtctccggcgagcggctttcnccgtcttactcgttaccttatgtcagctacttcgctacttctagtactaccttaccagctacttgacccttcaacctacgacccaccaccctttccgaaccgtacggtaccgttaaccggaaaccccgaccgttaccccccctaaaccccgaaaccgtaaacccgaccgaaactaaaaccggtccgttaaccggtcccttaccggacccccggacgttacccggtacggtttacccggttcgtaaccggttacgtttacccggttttaacccgtcccccgtttttaacgtaccgtttaccccgttcccccgtaccttaacgttaccgtcgtaaccgtcggttaaccggtacgg

SEQ ID NO: 316549 - DNA, 538 bp, Homo sapiens
  misc_feature: GZ8MTXP01AO77V.41.39.D06.1.454.CMB.2.raw
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagtctatactatcacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccacctctcctgtaggccagtcggagtgttgctaagtacctagcctaggtaccaacagaaacctggccaggctcccaggctcctcatctatgatgcatccaacagggtcactggccaccccgagacaggttcagtggcaggtgggtctagggacngacttcactctcaccgtnagcatgacagctagaagtntttncgtagtttatactgtcaggctagtataagtgactcggcctccgtcggccgtaaaggccagaacgtggaagtaacgttaaacgatgttggttccttgaaccaccgtaattcgtacgttcttccgttaacgttccccg

SEQ ID NO: 316550 - DNA, 618 bp, Homo sapiens
  misc_feature: GZ8MTXP02H3ZNM.41.39.D06.1.454.CMB.2.raw
  modified_base (259)..(259): a, c, t, g, unknown or other
  misc_feature (259)..(259): n is a, c, g, or t
  modified_base (382)..(382): a, c, t, g, unknown or other
  misc_feature (382)..(382): n is a, c, g, or t
tcagtctatactatcacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggagcgtggtccagcccgggagtccctgagactctctgtgtagcctntggttctcattcgatagtatttggttgctacgtggggtcccgccagggtcctccgaggccgaagggggccgaggtggggtgcagtcatcctccggagagtgggaaagtgaagtaagtattacncagactccgtagaaacggggcccaattccacctatcctccagacgactaaattaccaaagtaactaagtgctagttatttagactaaatgaacagcgtgagtagtgaacgacacgttcttagtttacttacgtgtacggtacggtacgggggtaaccctaaccggaaaggggtaaaaccgggttccgggggtaaaacttacgtaaacgttaaaaccgttacgtttaactttaacgg

SEQ ID NO: 316551 - DNA, 517 bp, Homo sapiens
  misc_feature: GZ8MTXP01ALX7A.19.10.A10.1.454.CMB.2.raw
  modified_base (436)..(436): a, c, t, g, unknown or other
  misc_feature (436)..(436): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (498)..(499): a, c, t, g, unknown or other
  misc_feature (498)..(499): n is a, c, g, or t
  modified_base (509)..(517): a, c, t, g, unknown or other
  misc_feature (509)..(517): n is a, c, g, or t
tcagtactctcgtgcacgaccggtgctcgatttagcgtcgatctcagggtccctgagactctcctgtagaagttatggattcaacttcgctagcggctggctgtgctgggttcgccaggctccagggaagggctggagtgggttggccacatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatacgtggggacgggggaaattgggggccagggaaccctggtcctccgtctcgtcagccctccaaccaaacgggccccatccggtccttccccctggccgcccctgcctccaggagcacctccgagacgcaacngccggcccctggggggctggccctagggtcaaggctacttcccacgagagtacgngngcggnngcgagcgcgnnnnnnnnn

SEQ ID NO: 316552 - DNA, 529 bp, Homo sapiens
  misc_feature: GZ8MTXP01DKFDR.19.10.A10.1.454.CMB.2.raw
  modified_base (409)..(409): a, c, t, g, unknown or other
  misc_feature (409)..(409): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (522)..(529): a, c, t, g, unknown or other
  misc_feature (522)..(529): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggagggctggagtgggttggccacatcaagaggagatatgaaggggaggcgacagactacgctgcacccgtgagaggcagatttaccatgtcaagagatgattcacaaagtacagtgtatctgcaaatgaacagcctgaagaccgaggacacagccaatttactattgtaacaaatgaatacgtagggggaacgggggaaaattgggggaccagggaccctggtcctccggtctcgtcagccctccaaccgaagggcccatccggtccttcccccgtgggccnccctgcctccgaggacgccacctccgagacgcacagcggcccctggggggcctgcctggcaaggcctacttcccacgngagtcnggaagcgggntggcaagggcgacnttagnnnnnnnn

SEQ ID NO: 316553 - DNA, 523 bp, Homo sapiens
  misc_feature: GZ8MTXP01CWY3M.19.10.A10.1.454.CMB.2.raw
  modified_base (192)..(192): a, c, t, g, unknown or other
  misc_feature (192)..(192): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
tcagtactctcgtgcacgaccggtgctcgatttagcgtcgatctcaggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttcttgcctggtaccagcagagacctggctaggctcccaggctcctcgttatggtncgtccaccagggccactggcactccccganaggttcagtggcagtgtgtctgggacagcttcactctcaaccatcagcagactgggacncctgaagatttgctagtgtattactgtacaacgatatgatgagttcaccgtcgtgtggtactagtttggccgaggggtaccaagggttaagaaagttacgaaacgacgtagtggcttgcaacatctgtcttctaattctcccg

SEQ ID NO: 316554 - DNA, 572 bp, Homo sapiens
  misc_feature: GZ8MTXP01D7QOJ.19.10.A10.1.454.CMB.2.raw
  modified_base (295)..(295): a, c, t, g, unknown or other
  misc_feature (295)..(295): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggtcncaggctccgagggagggctggagtgggttggccgcatcaaagaggagatagtgaagggggagcgacagactacgctgcacccgtgaacgaggcagatttaccgatgtacaagagatgattcaacaaagtacagtntatctagacaatanaacagactagaagaacgaggacacagacattactatagtanaaataagaagtagttaggggaacgggggaaaggttagggttcggacggaaccgtacggtaacgtcgtcgttacgtcgttcgaacccg

SEQ ID NO: 316555 - DNA, 516 bp, Homo sapiens
  misc_feature: GZ8MTXP01AORTQ.19.10.A10.1.454.CMB.2.raw
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
  modified_base (510)..(516): a, c, t, g, unknown or other
  misc_feature (510)..(516): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcaacaaagtacagtgtatctgcaaatgaaacagcctgaagaccgaggacacagccatttactattgtaacaaatgaatacgtgggggaacgggggaaaattgggggaccagggaaccctggtcctccgtctcgtcagccctccaaccgaagggcccatccggtcctccccctggccnccctgctccaggancacctcganacgcacngcgccctgggggctgcctggcaaggctacttcccagtagagtacnggaagcgggctgggcaaggcgcattagnnnnnnn

SEQ ID NO: 316556 - DNA, 541 bp, Homo sapiens
  misc_feature: GZ8MTXP01A35UT.19.10.A10.1.454.CMB.2.raw
  modified_base (411)..(411): a, c, t, g, unknown or other
  misc_feature (411)..(411): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (533)..(541): a, c, t, g, unknown or other
  misc_feature (533)..(541): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatggaaggggaggcgacagactacgctgcacccgtgagaggcagatttaccatgtcaagagatgattcaacaaagtacagtgtatctgcaaatgaacagcctgaagaccgaggacacagccatttactattgtaacaaatgaatacgtgggggaacgggggaaattggggaccagggaccctggtcctccgtctcgtcagccctccaaccgaaagggccccagttccggtccttcccccgtgggccnccctgacctccgaggcgccaccgtccgagacgcacacggcggtccctgggggctggccctagggtcaaggcctacgttccccagacgngtacgngnggcggctcggacgaggcncgttnagnnnnnnnnn

SEQ ID NO: 316557 - DNA, 564 bp, Homo sapiens
  misc_feature: GZ8MTXP01B612R.19.10.A10.1.454.CMB.2.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (389)..(389): a, c, t, g, unknown or other
  misc_feature (389)..(389): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttctgacgcagtctccaggcaccctgtctttgacccctggggaaangccaccctctcctgcagggctgataagagtgttgacagctaccttnttgcctggtaccagcagagacctggccaggctccccaggcctcctcgtttatgggtcgccgtcccaccgaggggccccacgtcgggaccacgtccccccggatagggtttcaggttggtagtggtgtcgtcgggacagtacttcactctcnccatcagcagacgtggacgcctagaagtatttgtctagttagttattactgtacaacgtatatgagtagacgttccaccgtccgtggtggacgtagttggccggagggaccgaaggttaaggaagttacgaaacgacgtggtgcgttgcaacatctgtcttactcttccttcccg

SEQ ID NO: 316558 - DNA, 516 bp, Homo sapiens
  misc_feature: GZ8MTXP01EZM2S.19.10.A10.1.454.CMB.2.raw
  modified_base (477)..(477): a, c, t, g, unknown or other
  misc_feature (477)..(477): n is a, c, g, or t
  modified_base (510)..(516): a, c, t, g, unknown or other
  misc_feature (510)..(516): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccattactattgtacaaatgaatacgtgggggaacggggggaaaattgggggaccaggggaaccctggtccctccgtctcgtcagccctccaaccaaagggcccatcggtcctccccctggccgccctgctccaggacgcacctccgagagcacagcggccctgggggctgcctggtcaaggctacttcccaganagtactgaagcgggctggcgaaggcgcattagnnnnnnn

SEQ ID NO: 316559 - DNA, 530 bp, Homo sapiens
  misc_feature: GZ8MTXP01B2LA0.19.10.A10.1.454.CMB.2.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccataagagtgttgacagcaccttcttgcctggtaccagcagacgacctggccaggcctcccaggctctgttanggtgcgtccacagggccactggcacgtcccccgataggttcaggtggcaggtgtgtctggggacagacttcactctcaaccatcagcagactgggacncctgaagtntttgactagtgttattactgtacaacgatatgatgagtcaccgtccgtggtgactagttcggacgagggtaccaaggtgaaacgttacgaaacgagtagtggcgttgccaactatctgtcttctaacttccgttccc

SEQ ID NO: 316560 - DNA, 512 bp, Homo sapiens
  misc_feature: GZ8MTXP01EI9J6.19.10.A10.1.454.CMB.2.raw
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
  modified_base (497)..(497): a, c, t, g, unknown or other
  misc_feature (497)..(497): n is a, c, g, or t
  modified_base (505)..(512): a, c, t, g, unknown or other
  misc_feature (505)..(512): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgcaaatgaacagcctagaagaccgaggacacagccattactattgtacaaatgaatacgtagggggaacgggggaaattggtgccaggggaaccctggtctcgtctcgtcaacgcctccaccaagggcccatccggtcttccccgtgccnccctgcctcaggncacctccgangcacagcggcccgtggggactgcctggtcaaggacctactccagacgagtcnggagcgggcttggcaagggcncagtaagnnnnnnnn

SEQ ID NO: 316561 - DNA, 554 bp, Homo sapiens
  misc_feature: GZ8MTXP01BS967.19.10.A10.1.454.CMB.2.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (547)..(554): a, c, t, g, unknown or other
  misc_feature (547)..(554): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaaacagcctgaagaccgaggacacagccatttactattgtaacaaatgaatacgtagggggaacgggggtaaaattgggggaccaggggaaccctggtccctccgtctcgtcagccctccaaccgaacgggccccagtccgggtccttcccccgngggcccnccctgcctcccgaggcncaccctcgagacgcacagccggccctggggggcctggccctggtccaagggcctacttccccgagtacgagtaccnggaacggcgggntcgggcaaagggcgcattagnnnnnnnn

SEQ ID NO: 316562 - DNA, 387 bp, Homo sapiens
  misc_feature: GZ8MTXP01B76NC.19.10.A10.1.454.CMB.2.raw
  modified_base (382)..(387): a, c, t, g, unknown or other
  misc_feature (382)..(387): n is a, c, g, or t
tcagtactctcgtgcacgaccggtgctcgatttagcgtcgatctcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtgacattggccaggggaccaaggttgaagtcaaacgaactgtggctgcacatctcgtcttcatcttcccgcatctgacacgagagtactgagcggctggcaaggcgcatagnnnnnn

SEQ ID NO: 316563 - DNA, 601 bp, Homo sapiens
  misc_feature: GZ8MTXP01EO459.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtcctgagactctcctgtagaagttatggattcaacttcgctagcggctggctgtgctgggtcgccaggctccgaggggagggctggagtgggtggccgcatcaagaggagatagtggaagggggagcgacagactacgctgcacccgtgaacgaggcagtatttaccatgtacaagagatgattcaacaaagtacaagtgtatctagacaaaatgaaacaggacctaggaaacgacccggaaggaaccacagacctaatttactattgaacaaagttgaaagtacggttagggggaaacgggggtaaaagttcgggggaccaacggggaacccctggggtccttccggtcttccggtcgaacggtcccc

SEQ ID NO: 316564 - DNA, 526 bp, Homo sapiens
  misc_feature: GZ8MTXP01EH9QL.19.10.A10.1.454.CMB.2.raw
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgacccctggggaaagagccaccctctcctgcagggccataagagtgtgacagcaccttcttgcctggtaccagcagagacctggccaggctcccaggctcctcgttatggtcgccgtccaccgagggcccacgtggcactccccganaggttcaggtcggcagtgtgtcgtgggacagacttcactctacaaccatcagcagactggacnctagaatatttgactagtagtatcactagtacaacgtatatggatgatcacgtcgtggtgactgttggacgtaggggactaaggtagaaagtacaaacgacgtggcgcttcgcactaatcctgttcttcaagttccc

SEQ ID NO: 316565 - DNA, 528 bp, Homo sapiens
  misc_feature: GZ8MTXP01CORYZ.19.10.A10.1.454.CMB.2.raw
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccataagagtgttgacagctaccttnttgcctggtaccagcagagacctggccaggctcccaggctcctgttanggtncgtccaccagggccatggcactccccganaggttcaggtggcagtgtgtctgggacagacttcactctcnccatcagcagactggacgcctgaagtatttgctagtgttattactgtacaacgatatgatgagtcaccgtccgtggtgactagttcggccgtaggggaccaagggttaagaaagttacaaacgacgtaggtggcgttgcaaccatctgtcttctaacttccgttcccg

SEQ ID NO: 316566 - DNA, 615 bp, Homo sapiens
  misc_feature: GZ8MTXP01D6I2W.19.10.A10.1.454.CMB.2.raw
  modified_base (458)..(458): a, c, t, g, unknown or other
  misc_feature (458)..(458): n is a, c, g, or t
  modified_base (568)..(568): a, c, t, g, unknown or other
  misc_feature (568)..(568): n is a, c, g, or t
  modified_base (608)..(615): a, c, t, g, unknown or other
  misc_feature (608)..(615): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcaacaaagtacagtgtatctgacaaatgaacagcctagaagaccgaggacacagccatttactattgtaacaaagtgaaagtacggtaggggggaaacggggggtaaaagttcgggggaccaaggggaaccctggtccctccgtctcgtcacgccctacccaaccgaacgggcccctagtcccggttcccttccccccgtgggcccgccccttgcctcccgagggacncccaacccgtccggaagacgaccacgacggccggcccgttgggggggcctcggtcccgtagggtaccaaagggtacccttaccgttaccccgaagtaacgtacgttaccngggaacggcggggactgggacgaaagggccgagttagagnnnnnnnn

SEQ ID NO: 316567 - DNA, 431 bp, Homo sapiens
  misc_feature: GZ8MTXP01B6MWM.19.10.A10.1.454.CMB.2.raw
  modified_base (217)..(217): a, c, t, g, unknown or other
  misc_feature (217)..(217): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (419)..(431): a, c, t, g, unknown or other
  misc_feature (419)..(431): n is a, c, g, or t
tcagtactctcgtgcacgaccggtgctcgatttagcgtcgatctcagggccgataagagtgttgacagcaccttctttgcctggtaccagcagagacctggccaggctcccaggctcctcgtttatggtgcgtccaccagggccactggcactccccgacaggttcagtggcagtgtgtctgggacagacttcactctcaccatcagcagactggancctagaagtattttgctagttgtattactgtacaaacgatatgatgagtctaccgtcggtggtggactagtttcggaccgagggggaacctaagggttagaagtacgaaaacgtactggtgctgcacatctcgtcttcattcctcccgacatcagacacgagtagtacgnggacggcgggcgtggacgaaggccganagtgnnnnnnnnnnnnn

SEQ ID NO: 316568 - DNA, 556 bp, Homo sapiens
  misc_feature: GZ8MTXP01AK5KL.19.10.A10.1.454.CMB.2.raw
  modified_base (544)..(544): a, c, t, g, unknown or other
  misc_feature (544)..(544): n is a, c, g, or t
tcagtactctcgtgcacgaccggtgctcgatttagcgtcgatctcagggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcgccaggctccgagggagggctggagtgggttggccgcatcaagaggagatatggaagggggaggcgacagactaccgctgcacccgtgaagaggcagatttaccatgtcaagagatgattcaacaaaagtacagtgtatctgacaaatgaacaggctagaagaccgagacacagccattactattgacaaatgaaagtacgttagggggaacgggggaaaattgggggccaggggaacccctggtcctccgtncgtcaaggcccc

SEQ ID NO: 316569 - DNA, 529 bp, Homo sapiens
  misc_feature: GZ8MTXP01EHK89.19.10.A10.1.454.CMB.2.raw
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccacctctcctgcagggccataagagtgttgacagctaccttnttgcctggtaccagcagagacctggccaggctcccaggctcctcgtttanggtncgtccacgagggccactggcatccccgataggttcagtggcagtgngtcgtcgggacagtacttcacttccacaaccatccagcagactgggacgcctagaagtatttgactagttgtatttactgtacaaacgattatgagtgagtcctacgtccggtggtggactagtttggccgagggtaccaggttgaagttacaaacgagtgngagttgcaacntctgtcttntcttctcccg

SEQ ID NO: 316570 - DNA, 630 bp, Homo sapiens
  misc_feature: GZ8MTXP01CKXME.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtggggggaggcgtggtccaggccccggggggtcctgagactctcctgtagaagttatggattcaacttcgctagcggctggctgtgcgtggtcgcaggctccgagggagggctggagtgggtgccgcatcaagaggagatagtggaagggggagcgacagactaccgctgcacccgtgaagaggcagtatttaccatgtacaagagatgattacaacaaagtacaagttgtaatctagactaaaatgaaacagggaccctaaggaaacgacccggaaggaaccaacacggtaaccctaattttaacctaattacgtaaacaaaattggaaagtacgggttaggggggaaaaccggggggtaaaagttcggggggacccgaagggggtaacccctgggttcctcccggtcttacggtccgaacgaacccc

SEQ ID NO: 316571 - DNA, 594 bp, Homo sapiens
  misc_feature: GZ8MTXP01CST3E.19.10.A10.1.454.CMB.2.raw
  modified_base (379)..(379): a, c, t, g, unknown or other
  misc_feature (379)..(379): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (551)..(551): a, c, t, g, unknown or other
  misc_feature (551)..(551): n is a, c, g, or t
  modified_base (583)..(583): a, c, t, g, unknown or other
  misc_feature (583)..(583): n is a, c, g, or t
  modified_base (586)..(594): a, c, t, g, unknown or other
  misc_feature (586)..(594): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaggggctggagtgggttggccgcatcaagaggagatatgaaggggaggcgacagactacgctgcacccgtgagaggcagatttaccatgtcaagagatgattcaacaaagtacagtgtatctgacaaatgaacagcctagaagaccgaggacacagccatttactattgtaacaaatgaatacgtagggggaacggggggaaaattgggggaccaaggggaaccctgggtacccctccggtactcgtcacnccctaccaaccgaaacgggcccctaagtcccggtcccttcccccgtcgggcccncccgttgcctaccgagggaccncaacccgtccgagacgcaacgcgtccggcccgtgggggcctcggccgtgggtaccaaacggtccttaccgtaccccgagtaagtacgttaaccggnggaacggtcgggcgcgggacgaacggcgacgngannnnnnnnn

SEQ ID NO: 316572 - DNA, 577 bp, Homo sapiens
  misc_feature: GZ8MTXP01E31L9.19.10.A10.1.454.CMB.2.raw
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (470)..(470): a, c, t, g, unknown or other
  misc_feature (470)..(470): n is a, c, g, or t
  modified_base (529)..(529): a, c, t, g, unknown or other
  misc_feature (529)..(529): n is a, c, g, or t
  modified_base (569)..(577): a, c, t, g, unknown or other
  misc_feature (569)..(577): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaagggctggagtgggttggccgcatcaagaggagatatggaaggggaggcgacagactacgctgcacccgtgagaggcagatttaccatgtcaagagatgattcaacaaagtacagtgtatctgacaaaatgaaacagcctagaagaccgaggacacagcctatttactattgtaacaaatgaaatacgtaggggggaaacgggggtaaaatgggggaccaaggggaaccctggtcctccgtntcgtcacgccctaccaaccgaacgggcccagtccggtccttcccccggngcccgtcctgcctcgaggacnccaccgcgagcgacacgcggccgtccgngggggctcggccgtaggaccaaacggtaccttaccgtacccgaaggtacgtacgtacgngggaacgggcgggcgtaggaaccgaagggcacgttagagnnnnnnnnn

SEQ ID NO: 316573 - DNA, 573 bp, Homo sapiens
  misc_feature: GZ8MTXP01BAGTM.19.10.A10.1.454.CMB.2.raw
  modified_base (292)..(292): a, c, t, g, unknown or other
  misc_feature (292)..(292): n is a, c, g, or t
  modified_base (342)..(342): a, c, t, g, unknown or other
  misc_feature (342)..(342): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctggtcnccaggctccgagggagggctggagtgggtgccgcagtcaagagagatagngaagggggagcgacagactaccgctgcacccgtgaacgagcagactttaccatgtcaaagagatgacttcaacaaagttcaaggtgtaatctagacaaatanaanagactagaagacgacgacgacacgacacttactattagtaataaataagaagtagttagggtaacgggggtaaagggttagggttcggacggaaccgtacggtcgtcgtcgttcgtcgcgtaaccg

SEQ ID NO: 316574 - DNA, 524 bp, Homo sapiens
  misc_feature: GZ8MTXP01A49BD.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (370)..(370): a, c, t, g, unknown or other
  misc_feature (370)..(370): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccgataagagtgttgacagctaccttctttgcctggtaccagcagagacctggccaggctcccaggctcctcgttanggtgcgtccaccgagggcccacgtggcacgtcccccganaggttcaggtggctagtgtgtctgggacagacttcactctcnccatcagcagctgggacgcctagaagtatttgctagttgtattactgtacacgatatgatgagtcactcgtgtgactagttggccgaggggaccaaggtcgaagttcgaaacgacgtgtcgcgttgcaaccatctgtcttctaacttcctcccg

SEQ ID NO: 316575 - DNA, 607 bp, Homo sapiens
  misc_feature: GZ8MTXP01A4B99.19.10.A10.1.454.CMB.2.raw
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (404)..(404): a, c, t, g, unknown or other
  misc_feature (404)..(404): n is a, c, g, or t
  modified_base (448)..(448): a, c, t, g, unknown or other
  misc_feature (448)..(448): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctggtcncaggctcgagggagggctggagtgggtgccgnatcaagaggagatagtggaagggggagcgacagactaccgctgcacccgtgaagaggcagtatttaccatgtacaaganatgaattcaaacaaagtacagttagtatctagacaaatgaaacngggcctaggaaacgaccgaagacacgagcctaatttacctatttagaaactaaagtgaaacgttacgggaggggggaaacgggggtaaaattcgggggaccgaacggggtaacccctggggtaacccttccggtcgttaccggtccgaacgtaaccccg

SEQ ID NO: 316576 - DNA, 563 bp, Homo sapiens
  misc_feature: GZ8MTXP01D0J2E.19.10.A10.1.454.CMB.2.raw
  modified_base (508)..(508): a, c, t, g, unknown or other
  misc_feature (508)..(508): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgctgggtcgccaggctccgagggaagggctggagtgggtgcgcatcaagaggagatagtggaaagggggagcgacagactaccgctgccacccgtgaaacgaggcagaatttaccatgtacaaagagatgaattcaaacaaaagtacaagtgtaatctagacaaatgaaacagggcctagaaacgaccgagacacagccattactattgaacaaatgaatacgnggggaaacggggaaattggggcaagggaaccctggctcgcttcgtcgaacgtccc

SEQ ID NO: 316577 - DNA, 528 bp, Homo sapiens
  misc_feature: GZ8MTXP01A1ZL4.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (387)..(387): a, c, t, g, unknown or other
  misc_feature (387)..(387): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctcctcgttanggtncgtccacgngggccacgtggccactccccgataggttcaggtggcagtgtgtctgggacagacttcactctcaaccatccagcagactgggacncctagaagtatttgctagttgtattacgtgtacaacgtatagtgatgagtcacgtcgtggtgatgttgcgagggaccgaaggtgaagttacgaaacgaacgtgtgacgttgcaactatctgtcttctaacttcgttccccg

SEQ ID NO: 316578 - DNA, 537 bp, Homo sapiens
  misc_feature: GZ8MTXP01B9DFK.19.10.A10.1.454.CMB.2.raw
  modified_base (193)..(193): a, c, t, g, unknown or other
  misc_feature (193)..(193): n is a, c, g, or t
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccgataagagtgttgacagcaccttcttgcctggtaccagcagagacctggccaggctcccaggctcctcgttanggtgcgtccacagggccactggcactccccgangtttcagtgcagtgtgtctgggacagacttcactctcncatcagcagactgggacgcctagaagtntttgctagttgtattactgtacaacgatatgtagtgagtcaccgtcgtggtgactagtttggaccgtaggggacctaagggttaagaaacgttacgaaacggacgttggtggcgttgcctaactagtctgtcttctaacttccgttccccg

SEQ ID NO: 316579 - DNA, 550 bp, Homo sapiens
  misc_feature: GZ8MTXP01EGALB.19.10.A10.1.454.CMB.2.raw
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagctaccttctttgcctggtaccagcagagacctggccaggctcccaggctcctcgttatggtgcgtccaccgagggcccactggcacgtccccgataggttcaggtggcagtgtgtcgtgggacagacttcactcncnccatcagcagactggancctgaagtatttgctagttagtattactgtacaacgatatagatagtagtcaccgtccggtggtggactaagtttcggaccgtaggggaccgtaagggttaagaagttacgaaacggttaacgtaggtggcttgacaaccatctgtcttctaacttcgtcccg

SEQ ID NO: 316580 - DNA, 566 bp, Homo sapiens
  misc_feature: GZ8MTXP01AQDDQ.19.10.A10.1.454.CMB.2.raw
  modified_base (193)..(193): a, c, t, g, unknown or other
  misc_feature (193)..(193): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (384)..(384): a, c, t, g, unknown or other
  misc_feature (384)..(384): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagctaccttctttgcctggtaccagcagagacctggccaggctcccgaggctctgttanggtncgtcacnggccatggcatccccganaggttcagtgcagtgtgtctgggacagacttcactctcaaccatcagcagactggacgctagaagtntttgctagtagtattactgtacaacgtatagtagagtgagttccaccgttccggtggtgacgtagtttggccgtaaggggaccctaagggttaagaaacggttacgaaaacggttacgttaggtcggttcgttggaccgtaactattccgttcggttccttacctaacgttcccgttccccg

SEQ ID NO: 316581 - DNA, 606 bp, Homo sapiens
  misc_feature: GZ8MTXP01CQGMY.19.10.A10.1.454.CMB.2.raw
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgcgtgggttcgccgaggctccgagggaaggggctgggagtgggttggccgcatcgaaagaggagatagtaggaaggggagcgaanagactacgctgcacccgtgaagagcagtatttacatgtacaagagatgattacgaanaaagtacagttagtaatctagacaaatgaaacngggacctagaaagaccgaagacacgagacctatttacctattgtaaacaaagtgaaagttacggttagggggaaaccgggggtaaaattcgggggaccaaggggaacccctgggtaacctcccggtacttccgcgaacgtccccg

SEQ ID NO: 316582 - DNA, 721 bp, Homo sapiens
  misc_feature: GZ8MTXP01D45HO.19.10.A10.1.454.CMB.2.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
tcagtactctcgtgcacgaccggtgctcgatttagcgtcgatctcagggggagttgctcagttaggacccagagggaaccatggaaaccccagcgcagcttctcttcctcctgctactctggctcccagatagcaccggagaaattttctgacgcagtctccaggcaccctgtctttgacccctggggaaanagcccaccctctcctgcagggccataagagtgttgacagcaccttnttgcctggtaccagcagacgacctggccaggcctacccgaggcctccgttcgtttagnggtcgccgtccccaaccgngggaccccacgtcggcctaaccccgtccccccggaagtacgggtttccaagggttcggccgtaggtttcgtcggtcgtacggggaaccctacggtacctttcacccttccctaaacccaaccctaagtcgaacggtaccaaggaccgttaggggacgtcccgtaggtaagttagttttcgacgtagttagttaactttacgtacgttaccgaagtatagtagtagtagggtacgttcgtaacccgttcggttggtacggtaacgtaggtttacgggaccggtaacggggtaaccgtaagggttacgaaaacgttaacgaaacggtaaaccgttggtaccgggtcttacgccttaccttaacttccgttcgttccttaccgttactttccccgttccccgtaacccg

SEQ ID NO: 316583 - DNA, 582 bp, Homo sapiens
  misc_feature: GZ8MTXP01ALDT1.19.10.A10.1.454.CMB.2.raw
  modified_base (385)..(385): a, c, t, g, unknown or other
  misc_feature (385)..(385): n is a, c, g, or t
  modified_base (488)..(488): a, c, t, g, unknown or other
  misc_feature (488)..(488): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcgccaggctcgagggagggctggagtgggtggccgcagtcgaagaggagatagtggaagggggaggcgacagactaccgctgcacccgtgaagngcagtattaccagtgtacaaagagatgaattcaaacaaagtacagtgtaatctagacaaatgaacagctagaagaccgagacacgagcctattactattaganaaatgaaatacggttagggggaaacgggggtaaagttcgggggacccgaggggtaacccctgggtcctcccgtacgttccgtaacgcgtccccg

SEQ ID NO: 316584 - DNA, 524 bp, Homo sapiens
  misc_feature: GZ8MTXP01BF7ZH.19.10.A10.1.454.CMB.2.raw
  modified_base (406)..(406): a, c, t, g, unknown or other
  misc_feature (406)..(406): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(524): a, c, t, g, unknown or other
  misc_feature (516)..(524): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcaacaaagtacagtgtatctgcaaatgaacagcctgaagaccgaggacacagccatttactattgtacaaatgaatacgtgggggacgggggaaaattgggggaccaggggaaccctggtcctccgtctcgtcagccctccaaccaagggcccatccggtcttccccctgggcccnccctagcctccgaggacgcaaccctccgagacgcacagcgcccctggggggcctgcctgggtcaaggctacttcccagagagtacngaagcggcnggcgaaggcngangnnnnnnnnn

SEQ ID NO: 316585 - DNA, 627 bp, Homo sapiens
  misc_feature: GZ8MTXP01EFE1B.19.10.A10.1.454.CMB.2.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (451)..(451): a, c, t, g, unknown or other
  misc_feature (451)..(451): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctccaggcaccctgtcttgaccctggggaaangccacctctcctgcagggccaataagngtgttgacagctaccttnttgcctggtaccagcagagacctggccaggcctccccgaggtcctccttcgtttatgggtcgccgtcccaccgaggggcccctaacgtcgggaccacgtccccccggaagtagggtttccccaggttcgggctaggttggtcgtcgtggggactaggtaccttcactctacaccatcagcagactggacgcctagaagttnttgacgtagttgttaagttacgtgtaacgtaacgtatagtagtagtacgtacgtcctaccgttcgggtgggtaacgtaacgttaggttcgggaaccggtaaacggggtaacgttaagggttagaaacgttaacgaaaacggtaacgttagggtacggttactaacgaacctaaccg

SEQ ID NO: 316586 - DNA, 628 bp, Homo sapiens
  misc_feature: GZ8MTXP01EW430.19.10.A10.1.454.CMB.2.raw
  modified_base (423)..(423): a, c, t, g, unknown or other
  misc_feature (423)..(423): n is a, c, g, or t
  modified_base (617)..(617): a, c, t, g, unknown or other
  misc_feature (617)..(617): n is a, c, g, or t
  modified_base (619)..(620): a, c, t, g, unknown or other
  misc_feature (619)..(620): n is a, c, g, or t
  modified_base (622)..(624): a, c, t, g, unknown or other
  misc_feature (622)..(624): n is a, c, g, or t
  modified_base (627)..(628): a, c, t, g, unknown or other
  misc_feature (627)..(628): n is a, c, g, or t
tcagtactctcgtgcacgaccggtgctcgatttagcgtcgatctcaggggtcccgtgagactctcctgtagaagttatggattcaacttcgctagcggcctggctgtgctgggttcgccaggctccagggaaggggctggagtggggttggccgcatcaagaggagatatgaaggggaggcgacagactacgctgcacccgtgagaggcagatttaccatgtacaagagatgattcaacaaagtacagtgtaatctgacaaatgaacagcctagaagaccgaggacacagccatttactattgtaacaaatgaatacggtaggggggaacggggggtaaaagttgggggaccaaggggaaccctggtcccctccgtctcgtcacgccctccaaccgaagggcccagtccggtccttcccccgnggcccgccctgcctcccgagggacgcctaacccgtccggagacgccaacgacggccgggccccttggggggccttaggaccccttggggtaccaaacgggtacccttaccgttccccaacgggtaagtacggttaaccgtgggaacgggtcccgggggcttcgggggaccaaaaggggggcccacgagttaggngnngnnntgnn

SEQ ID NO: 316587 - DNA, 627 bp, Homo sapiens
  misc_feature: GZ8MTXP01ADG8H.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttcttgcctggtaccagcagagacctggccaggctcccaggctcctcgtttanggtgcgtccaccgagggcccacgtggccacgtcccccganggttcaggtggcagtgtgtctgggacngacttcactctcnccatcagcagctgggancctagaagtntttgctagtagttattacgtagttacaaacgtattagtagaggtagtaacgtcctaacccgttccggtgggtacggtaacgttacggtttcgggacccggtaacgggggtaaccgtaaaggggtttaacggaaacggttaacggaaaacggttaaacggttgggtacgggttcgttacggacctaaccgtacttccgttacgttcctttacgtaacgtttcccgttccccg

SEQ ID NO: 316588 - DNA, 508 bp, Homo sapiens
  misc_feature: GZ8MTXP01A0ABR.19.10.A10.1.454.CMB.2.raw
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (474)..(474): a, c, t, g, unknown or other
  misc_feature (474)..(474): n is a, c, g, or t
tcagtactctcgtgcacgaccggtgctcgatttagcgtcgatctcagggagctgctcagttaggacccagagggaaccatggaaacccagcgcagcttctcttcctcctgctactctggctcccagatagcaccggagaaattttcttgacgcagtctccaggccacctgtctttgacccctggggaaagagccaccctctcctgcagggccataagagtgttgacagcaccttnttgcctggtaccagcagagacctggccaggctcccaggctcctcgttanggtgcgtccacagggccactggcatccccganaggttcagtggcagtgngtctgggacagacttcactcncaacatcagcagactgganctgagatttgctagtgtattactgtacaacgatatgagtgagtcaccgtcgtggtggatgttggccgaggggaccaagggttgaagttcaaacgacgtagngcgttgacaacatcgtgtcttctcttcttccccg

SEQ ID NO: 316589 - DNA, 571 bp, Homo sapiens
  misc_feature: GZ8MTXP01CW2DZ.19.10.A10.1.454.CMB.2.raw
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
  modified_base (383)..(383): a, c, t, g, unknown or other
  misc_feature (383)..(383): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtcttgacccctggggaaagagccaccctctcctgcagggccgataagagtgttgacagcaccttnttgcctggtaccagcagagacctggccaggcctccaggctcctgttatggtgcgtcaccgagggccagtggcactccccganaggttcagtggcagtgtgtcgtgggacagacttccactctcaaccatcgagcagactgggacnctagaagtatttgctagtagttattactgtacaacgtatagtagtatagacgttaccaccgttccgtaggtggtactaggtttcggaccggtaggggtaacctaagggttaagaaggttacgtaaacgaacgtaggtggttacgttgaccgtaacacgttcgttgtacttctaacttccgtttccccg

SEQ ID NO: 316590 - DNA, 651 bp, Homo sapiens
  misc_feature: GZ8MTXP01ALZVC.19.10.A10.1.454.CMB.2.raw
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggtcgccaggctcgagggagggctggagtgggtggccgcatcaagaggagatagtggaagggggaggcganagactaccgctgcacccgtgaagngcagtattaccatgtacaaagagatgtaacttacaaacgtaaagtaacaggttagtatctagaactaaagtacgaaacacggggactaaggaaaccgaccggaaaggaccaacgacggtacccttaatttaaccttagttaacctaaagaaatgttaaaggtacggggttaaggggggtaaacgggggtaaaggttccgggggacccgttaacggggtaacccgtcgggtccttacccggtcgttaccggtccgccggtaacccccg

SEQ ID NO: 316591 - DNA, 597 bp, Homo sapiens
  misc_feature: GZ8MTXP01D14GP.19.10.A10.1.454.CMB.2.raw
  modified_base (432)..(432): a, c, t, g, unknown or other
  misc_feature (432)..(432): n is a, c, g, or t
  modified_base (584)..(584): a, c, t, g, unknown or other
  misc_feature (584)..(584): n is a, c, g, or t
  modified_base (589)..(597): a, c, t, g, unknown or other
  misc_feature (589)..(597): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtacaagagatgattacaactaaagtacagtgtatctgacaaatgaacagcctagaagaccgaggacacagcctaatttactatagtaacaaatgaaatacggtagggggaaacggggggtaaaagttcgggggaccgaaggggaacccgtggtccctaccgtctcgtcacgaccctccaaccgaacggcccacgttccggtcccttcccccgnggcccgcccgtcgcctacccgaggacgccacccgtcgaagcgacaacgcggtccggcccgtggggggctcggcctgggacaaacggccctacttccccgaagacggtacgtaaccgtggaacggccgggcgtcgggacgaaaggggcccagngaggnnnnnnnnn

SEQ ID NO: 316592 - DNA, 521 bp, Homo sapiens
  misc_feature: GZ8MTXP01A2ZJ8.19.10.A10.1.454.CMB.2.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (468)..(468): a, c, t, g, unknown or other
  misc_feature (468)..(468): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtcttgacccctggggaaangccaccctctcctgcagggccgataagagtgttgacagcaccttnttgcctggtaccagcagagacctggccaggctcccaggctcctcgttanggtncgtccaccgagggcccacgtggccatcccccganaggttcaggtggcagtgngtctgggacagactcactcncnccntccagcagctggancngaagtatttgctagtagtattactgtacaacgatatgagtgagtccaccgtcgtggtgactagttggccgagggaccgaaggttnaagttcaaacgacgtggtagcgttgcaaccgatctgtcttctcttccgtcccg

SEQ ID NO: 316593 - DNA, 545 bp, Homo sapiens
  misc_feature: GZ8MTXP01AR3DF.19.10.A10.1.454.CMB.2.raw
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (534)..(534): a, c, t, g, unknown or other
  misc_feature (534)..(534): n is a, c, g, or t
  modified_base (537)..(545): a, c, t, g, unknown or other
  misc_feature (537)..(545): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcaacaaagtacagtgtatctgcaaatgaacagcctgaacgaccgaggacacagccatttactattgtaacaaatgaatacgtagggggaacggggggaaaattgggggaccagggaaccctggtccctccgtctcgtcagccctccaaccgacgggcccatccggtccttcccccnggcccgccctgcctcgaggcnccacctccgagacgcacaggccgccctggggggctggcccctgggtccaagggcctacttaccccgaagacgagttaccgnggcggcggcncgggacgaaggccagnagnnnnnnnnn

SEQ ID NO: 316594 - DNA, 685 bp, Homo sapiens
  misc_feature: GZ8MTXP01B1E5V.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggcccgggggtcctgagactctcctgtagaagttatggattcaacttcgctagcggctggctgtgctgggttcgccaggctccgaggggaagggctggagtgggttggccgcatcgaaggaggagatagtaggaaagggggaggcgaacgaggactaaccggctgccaccccggtgaaaggacggcagtaatttaccatgtacaaagagatgtattacaactaaaagtacagttagtatactgacaaatagaaacagggacctaggaaacggacccgaaagggaacctaacgaacgaccctaattttaacctaagtttgtaaactaaaagttaagaaaacgtttaaccggggttaggggggaaaaccgggggggtaaaagtttacgggggggacccgaacgggggtaaaccccgtcgggggttaacctccccggttacgttcccggtccgttaacggtccccccg

SEQ ID NO: 316595 - DNA, 648 bp, Homo sapiens
  misc_feature: GZ8MTXP01BTFK0.19.10.A10.1.454.CMB.2.raw
  modified_base (334)..(334): a, c, t, g, unknown or other
  misc_feature (334)..(334): n is a, c, g, or t
  modified_base (639)..(639): a, c, t, g, unknown or other
  misc_feature (639)..(639): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttaattttaaaaggtgtcctgtgtgaggtgcgcctggtggagtcgtgggggaggcggtggtccgaggccccggggggtcctgagactctcctgtagaagttatggattcaacttcgctagcggctggctgtgcgtggtcgccaggctccgagggagggctggagtgggtgccgnatacaagaggagatagtaggaagggggaggacgaacgagacctaccgctgaccgacccgtgaaagaggcaagtaactttaccatgtacaaagagtatgaattacaaacgtaaaagtacaagttgttaatccgtagaactaaaagtcgaaactacgggacctaaggaaaccgaccggaaggaccaacgagtacctattttaacgatttagaaacaaaagttgaaacgtacgggaggggggaaaaccggggtaaagttcgggggaccgaacggggtaaccctgggtcctcccgggtcttaccggtcncgtaacccc

SEQ ID NO: 316596 - DNA, 618 bp, Homo sapiens
  misc_feature: GZ8MTXP01B9NDM.19.10.A10.1.454.CMB.2.raw
tcagtactctcgtgcacgaccggtgctcgatttagcgtcgatctcagggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggagcgtggtccaggcccgggggtcctgagactctcctgtagaagttatggattcaacttcgctagcggctggctgtgctgggttcgccaggctccgagggaaggggctgggagtgggttggccgcatcaagaggagatagtggaagggggagcgacagactacgctgcaccgtgaagaggcagtatttaccatgtacaagagatgattacaacaaagtacaagttgtatctagactaaatgaaacaggcctagaaacgaccgaggaccacgacgacctaatttaactatttacgaactaaaagtcgaaagttacgggttaggggggaaacgggggtaaagttcggggggccgttaacggggtaaccccgtggggtaacccttcccgggtcgttaccgtccgttaacggtccccc

SEQ ID NO: 316597 - DNA, 535 bp, Homo sapiens
  misc_feature: GZ8MTXP01AFKOD.19.10.A10.1.454.CMB.2.raw
  modified_base (192)..(192): a, c, t, g, unknown or other
  misc_feature (192)..(192): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
  modified_base (512)..(512): a, c, t, g, unknown or other
  misc_feature (512)..(512): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtcttgacccctggggaaangccaccctctcctgcagggccataagagtgttgacagctaccttcttgcctggtaccagcagagacctggccaggctcccgaggctcctcgttanggtcncgtccaccgagggcccacgtggccacgtcccccgataggtttcaggtggcaggtgtgtcgtgggacagacttcactcncaaccatccagccagactggacnctagaagtatttgctagttagtattactgtacaagtatatgatgagtcaccgtcgtgtgactagttcggccgagggactaagggtgaagttacgaaacgacgtggtgcgttgcaacctntctcgtccttctcgttcctcccg

SEQ ID NO: 316598 - DNA, 540 bp, Homo sapiens
  misc_feature: GZ8MTXP01EAXEI.19.10.A10.1.454.CMB.2.raw
  modified_base (193)..(193): a, c, t, g, unknown or other
  misc_feature (193)..(193): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctctcgttanggtncgtccaccagggccactggcatccccganaggttcaggtggcagtgtgtctggggacagacttcactcncnccatcagcagactgggacgcctgaagtatttgctagttagttattactgtacaacgtatatgatgagtcaccgtcgtggtgactagttggcgagggggtaccaagggttaagaaagttacgaaacgttacgtcggtggcttggcaacctatctgtcttctaacttccgttaaccccg

SEQ ID NO: 316599 - DNA, 620 bp, Homo sapiens
  misc_feature: GZ8MTXP01D1GOK.19.10.A10.1.454.CMB.2.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttctgacgcagtctccaggcaccctgtcttgacccctggggaaanacgccaccctctcctggcagggccataagagtgttgacagctaccttnttgcctggtaccagcagagacctggccaggcctcccgaggtcctcctcgtttagnggtcgccgtccaccgngggcccacgtcggccacctccccggagtacggttcaggtgctaggtgtcgtcgtacgggactagtaccttcacctcctacaacctatccgaagctaagcgtagggactacgtgtaagtntttgcgtaagttagttattacgtagtacaagtatatgtagtagtacgtctaccgttcggtgtaggtacgttaggtttcggaccggtaggggtaaccgtaagggttaacgaaacgttacgaaaacgttacgtcggtaggccttcggacctaacctattcgttcgtccttactaaccgttcccttaaccccg

SEQ ID NO: 316600 - DNA, 524 bp, Homo sapiens
  misc_feature: GZ8MTXP01DV6S0.19.10.A10.1.454.CMB.2.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
tcagtactctcgtgcacgaccggtgctcgatttagcgtcgatctcagggggagctgctcagttaggacccagagggaaccatggaaacccagcgcagcttctcttcctcctgctactctggctcccagatagcaccggagtaaattttcttgacgcagtctccaggcaccctgtctttgacccctggggaaagngccacctctcctgcagggccgataagagtgttgacagcaccttctttgcctggtaccngcagagacctggccaggctcccaggctcctcgttatggtncgtcacagggccatggcacgtccccganaggttcagtggcagtgtgtcgtgggacagacttcactctacaaccatcagcagactgggacnctgatatttgcagtagtattactgtcaagatangatgatcacctcgtgtgctaatttggcgtagggaccgtaaggttaagaagttctaaacgacgtaggtaggcgttgctaaccattcctggtcttctaacttcgttccccg

SEQ ID NO: 316601 - DNA, 654 bp, Homo sapiens
  misc_feature: GZ8MTXP01D9GE2.19.10.A10.1.454.CMB.2.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (603)..(603): a, c, t, g, unknown or other
  misc_feature (603)..(603): n is a, c, g, or t
tcagtactctcgtgcacgaccggtgctcgatttagcgtcgatctcaggggcagagctctggagaagagctgctcagttaggacccagagggaaccatcggaaaccccagcgcagcttctcttcctcctgctactctggcctcccagatagcaccggagtaaattttctgacgcagtctcaggccaccctgtcttcgacccgtaggggaaancgcccacctctcctgcgagggccaataagngtgtgacagctacctttnttgccgtggtaccagcagacgacctggccaggcctcccgaggtcctccgttcgtttatggtcgccgtacccaccgacgggcccacgtcggacctaccgtcccccgagtacggttcccgaggtcggctaggttcggtcgtcgtgggacacggtaccttcactctacacctatcagcagtcgtagggactccgtaggtaacgttagtttcgacttaaggttcgtttaaactttacgttggtaacaacggttatagtagtagtacgtacgttcctaccggttccgggttgggtaacggtaccttaggtttccgggaacggtaacgggggtaaccgttaaaggggttnaaaacgggtaacgaaaaacggtcgttcggagggttctaacggccttaaccg

SEQ ID NO: 316602 - DNA, 633 bp, Homo sapiens
  misc_feature: GZ8MTXP01DCTP5.19.10.A10.1.454.CMB.2.raw
tcagtactctcgtgcacgaccggtgctcgattttagcgtcgatctcaggggggggagaggagtcccagcccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtcctgagactctcctgtagaagttatggattcaacttcgctagcggctggctgtgcgtggttcgccgaggctcgagggagggcgtggaggtgggtgccgcatcgaagaggagatagtaggaagggggaggacgaacgagacgtaccgctgccgacccgtgaagaggcagtattaaccatgtacaagagatagaattacaaataaagtacaagtagtatactagacaaaatagaaacgacggaccgtaaggaaacgaaccggaaggaaccaacgacgacctaatttaactaattagaaactaaagtagaaagtaacgggttagggggaaacgggggtaaaagttcggggacgaacgggtaacccgtggtccgtccgtcgttcgtccgaacgtaaccccg

SEQ ID NO: 316603 - DNA, 599 bp, Homo sapiens
  misc_feature: GZ8MTXP01AWOHD.19.10.A10.1.454.CMB.2.raw
  modified_base (409)..(409): a, c, t, g, unknown or other
  misc_feature (409)..(409): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtcctgagactctcctgtagaagttatggattcaacttcgctagcggctggctgtgctgggtcgccaggctccgagggagggctggagtgggtggccgcatcgaagaggagatagtggaagggggaggcgacagactaccgctgcacccgtgaagaggcagatttaccatgtacaaaganatgaattcaacaaagtacagtgtatctagacaaatgaacaggcctagaacgaccgagacacagacctatttaactattagaaactaaatgaaagtacggttaggggggaaacgggggtaaaagttcggggggaccgaacgggggtaacccctggggttaacctcccggtcgttccgtccgaacgtccccg

SEQ ID NO: 316604 - DNA, 595 bp, Homo sapiens
  misc_feature: GZ8MTXP01A6TQ2.19.10.A10.1.454.CMB.2.raw
  modified_base (346)..(346): a, c, t, g, unknown or other
  misc_feature (346)..(346): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggagggctggagtgggtggccgcatcaagaggagatagnggaagggggaggcgacagactaccgctgcacccgtgaagaggcagtatttaccgatgtacaaagagatgattacaacaaagtacagtgtaatctagacaaatgaacaggacctagaaacgaccgagacacagacctatttactattgaacaaatgaaatacgggagggggaaacgggggtaaaattcgggggaccttaacggggtaaccccgtgggtcccgtaccggtccgttcgtccgaacgtccccg

SEQ ID NO: 316605 - DNA, 649 bp, Homo sapiens
  misc_feature: GZ8MTXP01ESDLW.19.10.A10.1.454.CMB.2.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(642): a, c, t, g, unknown or other
  misc_feature (641)..(642): n is a, c, g, or t
  modified_base (644)..(645): a, c, t, g, unknown or other
  misc_feature (644)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaacagcctagaagaccgaggacacagcctatttactatttgtaacaaatgaaagtacggtaggggggaaacggggggtaaaattgggggaccaaggggaaccctggtccccgtccggtctcgtcacgccctaccaaccgaaacgggcccacgttccggtccttcccccgngggcccnccctgcctcgacggacgcaccctccgaagacgcacgacggcccggccccgtggggggccttacgggcccgtttacggggaccaaaacgggtcccttaacccgttacccccggaaagtaacggtaacgttaacccgggtggggaaccggggtccgggttcgtacggggaccgaaacggggtccgttaccgttaagacgaagngngnngnngngn

SEQ ID NO: 316606 - DNA, 621 bp, Homo sapiens
  misc_feature: GZ8MTXP01C2W47.19.10.A10.1.454.CMB.2.raw
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
  modified_base (571)..(571): a, c, t, g, unknown or other
  misc_feature (571)..(571): n is a, c, g, or t
  modified_base (608)..(608): a, c, t, g, unknown or other
  misc_feature (608)..(608): n is a, c, g, or t
  modified_base (613)..(621): a, c, t, g, unknown or other
  misc_feature (613)..(621): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaagaccgaggacacagccatttactattgaacaaatgaaatacgtagggggaacgggggaaaagttgggggaccaacggggaccctggtacccctccggtctcgtcagccctaccaaccgaaacgggcccaagtccggtcccttccccccgngggcccnccccttgccctaccgagggacgacccaccctccggagacgaccaacncgggtcccgggccccgtggggggggccttcgggcccttcggggtaccaaacgggtacccttaaccgtttacccccgaacgtaaggacgttaaccngggaacggggcggccggtaggaccgaagggcttacgnttagnnnnnnnnn

SEQ ID NO: 316607 - DNA, 640 bp, Homo sapiens
  misc_feature: GZ8MTXP01A1UFE.19.10.A10.1.454.CMB.2.raw
  modified_base (193)..(193): a, c, t, g, unknown or other
  misc_feature (193)..(193): n is a, c, g, or t
  modified_base (395)..(395): a, c, t, g, unknown or other
  misc_feature (395)..(395): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccgataagagtgttgacagctaccttcttgcctggtaccagcagagaccgtggccaggcctcccgaggtcctcctcgttatggtgcgtcccaccgagggcccacgtggccacgtcccccgataggttcaggtggcaggtgtcgtcgtcggggactaggtacctttcaccttctaccaaccgtntcgagcaaggtcctgggacgtccgtagaagttatttgactagttagtattacgtgtacaaacgtatagtgagtgtaacgtcctaccgttccggtggtacggacgtaggtttcgggaccgtagggggtaacctaaagggttaacgaaaggttaccgaaaacggttaccgttagggtacgggttaccgttcggaccctaacccgtattccgttacgttccttactaaccgtttccccgttaaccccg

SEQ ID NO: 316608 - DNA, 593 bp, Homo sapiens
  misc_feature: GZ8MTXP01CQXOZ.19.10.A10.1.454.CMB.2.raw
  modified_base (445)..(445): a, c, t, g, unknown or other
  misc_feature (445)..(445): n is a, c, g, or t
  modified_base (585)..(593): a, c, t, g, unknown or other
  misc_feature (585)..(593): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggagggctggagtgggttggccgcatcaagaggagatatggaaggggaggcgacagactacgctgccacccgtgagaggcagatttaccatgtacaagagatgattcaaacaaagtacagtgtatctagacaaatgaacagcctagaacgaccgaggacacagcctatttactattagaacaaatgaatacggtaggggggaaacgggggtaaagtgggggaccagggaccctggtccctccgtctcgtcacgccctaccaaccgacgggcccagtccggtcctcccccgtgggccctccctgccctccgagggaccnccaccgtcgagacgcacgcggccggcccgtggggggcctggccccgtagggtacccaaacggtcccttaccgtacccccgaaaggtacgacgtaccgtgggaaccgggcggggctcggggacgaacgggcgacttagagnnnnnnnnn

SEQ ID NO: 316609 - DNA, 615 bp, Homo sapiens
  misc_feature: GZ8MTXP01DGWP4.19.10.A10.1.454.CMB.2.raw
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggccccggggggtccctgagactctcctgtagaagttatggattcaacttcgctagcggctggctgtgctggtcgcaggctccgagggagggcnggagtggtgcgnatcgaagagagatagtaggaaggggagcgacagactacgctgcacccgtgaagagcagtatttaccatgtacaagagatagattacaacaaagtaacagttagtatactagaacaaagtacgaaacaggaccctaaggaaacgaccggaaggtaaccacgacgacctatttactattacgtaaacaaatagaaagtacggttagggggaaacgggggtaaagttcgggggaccgaacggggtaaccccgtggtcccgttccggtcgttacggtccaacggtaaccccg

SEQ ID NO: 316610 - DNA, 583 bp, Homo sapiens
  misc_feature: GZ8MTXP01CPEPM.19.10.A10.1.454.CMB.2.raw
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccgganaaattttctgacgcagtctccaggcaccctgtctttgacccctggggaaangccaccctctcctgcagggccataagagtgtgacagctaccttnttgcctggtaccagcagacgacctggccaggctcccgaggtcctccttcgttancggtcgccgtccaccgagggcccacgtggcctaacgtcccccgataggtttccaggtcggcaggttgtgtcgtggggaccaggtacttcacttcctacaaccatcagtcaagtaccgtgggacgctagaagtatttgctagtgttattactagtacaacgtatagtgtatacgtagtccaccgtcggtggtacgtactagttcggaccgaggggtaccaagggttgaaacgttacaaacgacgtaggtggacgttgaccaacgtatcgtcgtcttactaacttccgttccccg

SEQ ID NO: 316611 - DNA, 566 bp, Homo sapiens
  misc_feature: GZ8MTXP01EG9Y4.19.10.A10.1.454.CMB.2.raw
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggcccgggggtcctgagactctcctgtagaagttatggattcaacttcgctagcggctggctgtgctggtcgcaggctcgaggagggctggngtggtgccgnatcaagaggagatagtggaaggggngcgacagactacgctgcacccgtgaagaggcagtatttaccatgtacaagagatgattcaacaaagtacagtgtaatcagacaaatgaacagggctaggaaagaccgagacactagacctattactattgtaacaaatgaaatacggttagggggaaacgggggtaaaattcgggggccaggggaacccctggtcctccgtcgttccgtcgaacgtccc

SEQ ID NO: 316612 - DNA, 585 bp, Homo sapiens
  misc_feature: GZ8MTXP01C4U3D.19.10.A10.1.454.CMB.2.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (330)..(330): a, c, t, g, unknown or other
  misc_feature (330)..(330): n is a, c, g, or t
tcagtactctcgtgcacgaccggtgctcgatttagcgtcgatctcaggggggagctgctcagttaggacccagagggaaccatggaaaccccagcgcagcttctcttcctcctgctactctggctcccagatagcaccggagaaattttctgacgcagtctccaggcaccctgtcttgacccctggggaaangccaccctctcctgcagggccataagngtgtgacagctaccttnttgcctggtaccagcagacgaccgtggccaggcctcccgaggcctcctcgtttatggtcgcgtccaccgaggcccacgtggcacgtcccccganaggttcaggtggctagtgtgtcgtagggacagtcttcactctacgaaccatcaagccagactgggacgtctagaagtatttggactaggtattattactggtacaagtatagtagaagtcgacgttaccgaccgttcggtaggtaggtactaaaggtttcggaccgtaaggggacctaaagggtttgaaacgttacgaaaacgttacgtggtacggcttgactaaccatcgtacgtcttctaacgttcctccccg

SEQ ID NO: 316613 - DNA, 609 bp, Homo sapiens
  misc_feature: GZ8MTXP01D2LPU.19.10.A10.1.454.CMB.2.raw
  modified_base (336)..(336): a, c, t, g, unknown or other
  misc_feature (336)..(336): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgctattttaaaaggtgtcctgtgtgaggtgcgcctggtggagtcgtgggggaggcgtggtccgaggccccggggggtcctgagactctcctgtagaagttatggattcaacttcgctagcggctggctgtgcgtggttcgccgaggctccgagggaaggggctggagtgggtggccgnatcaaaggaggagatagtagggaaggggagacgacgagactaccgctgccgacccgtgaagngcagtactttaccatgtacaagnatgattacaactaaagtacagttgtatctagaacaaatagaacaggacctagaacgaccgagacagatacctaattactatacaactaaatggaagtacgggttagggggaaacgggggtaaacgttcggggaccgacggggtaaccccgttggtcccgtcccgtcgttaccgtccgcgtaacccccg

SEQ ID NO: 316614 - DNA, 632 bp, Homo sapiens
  misc_feature: GZ8MTXP01BH34W.19.10.A10.1.454.CMB.2.raw
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtatttttcctttctgtcttaattttaaaaggtgtcctgtgtgaggtgcgcctggtggagtcgtgggggaggcgtggtccgaggccccgggggtcctgagactctcctgtagaagttatggattcagcttcgctaggcggctggctgtgctgggtcgcaggctcgagggagggctggaggtgggttggccgcatcgaagaggagatagtaggaagggggagcgacagacctacgctcgccacccgtagacgnggcaagtactttaccatgacaaaganatagattacaaacgtaaagtactagtataatctagacaaatagaacgagaccgtagaacggaccgaggacacgaagtacctaatttactaattagtaaactaaagttaggtaaacgttaacgggtaaggggggaaacgggggttaaaaggttcggggaacccggtaacgggtaacccgtggttccgtccgttcgtaaccgttcgaaccgg

SEQ ID NO: 316615 - DNA, 660 bp, Homo sapiens
  misc_feature: GZ8MTXP01CRLGA.19.10.A10.1.454.CMB.2.raw
  modified_base (349)..(349): a, c, t, g, unknown or other
  misc_feature (349)..(349): n is a, c, g, or t
  modified_base (476)..(476): a, c, t, g, unknown or other
  misc_feature (476)..(476): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccgaggccccggggggtccctgagactctcctgtagaagttatggattcaacttcgctagcggctggctgtgctggtcgccaggctccgagggagggctggagtgggtgccgcatcaaagaggagatagnggaagggggagcgaacagactaccgctgcacccgtgaagaggcagtattaaccatgtacaaagagtatagaacttacaaacgtaaaagtagaagttagtaatccgtagaaactaaaagtcgaaaacncgggaaccctaggaaaacgaacccggaaggaaccaacgtacgtaaccctaattttaaacctaagttagtaaaacaaaagtcggaaaagttaccgggaggggggtaaaaccgggggtaaaagttcgggggaaccgaacggggtaaccctgggttcctaccggtcgttaccgtcgaacgtaacccc

SEQ ID NO: 316616 - DNA, 602 bp, Homo sapiens
  misc_feature: GZ8MTXP01DSH16.19.10.A10.1.454.CMB.2.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (392)..(392): a, c, t, g, unknown or other
  misc_feature (392)..(392): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctcaggcaccctgtcttgacccgtggggaaangccacctctcctgcagggccaataagagtgtgacagctacctttnttgcctggtaccagcagagacctggccaggcctcccgaggtcctcctgtttangggtcncgtccaccgagggcccaagtggacacgtccccgatacggttccaggtggctagtgtcgctgggatgacttcactctacacatnacgcaggactaggacgtccgtagtaagttatttcggattaaggtgttaagtttaaacgtggttaaccaaacggtataagttaggtaacgttaggtaacttccgtaacccgttccggttgggtaaggtaccgttaggtttacggaccgggtaaggggaccttaaagggttgaaacggttaacaaaacggtcgtaggcggactcggctaacg

SEQ ID NO: 316617 - DNA, 628 bp, Homo sapiens
  misc_feature: GZ8MTXP01AF9UO.19.10.A10.1.454.CMB.2.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgacccctggggaaagagcccaccctctcctgcgagggccgataagagtgttgacagctaccttcttgcctggtaccagcagagacctggccaggcctccccgaggcctccctgtttatgggtcnccgtcccaccgaggggccccacgtggaccacgtcccccggagtggtttccaggtggctagtgtgtctgggacngtaccttcactctcaaccntccagccagctgggacgcctagaagtatttgacgtagttgttattacgtgttacaacgtattagtagagtagtacgtccgtaccgttccggtagggttggacgttaggtttcgggaccggtaacggggtaaccgtaagggtttaagaaacggttaccgtaaaacggttaacgtagggtcggcgttcgaccgtaaccctagttcttacgttccttactaacgttcccttccccg

SEQ ID NO: 316618 - DNA, 571 bp, Homo sapiens
  misc_feature: GZ8MTXP01A8DHY.19.10.A10.1.454.CMB.2.raw
  modified_base (292)..(292): a, c, t, g, unknown or other
  misc_feature (292)..(292): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (551)..(551): a, c, t, g, unknown or other
  misc_feature (551)..(551): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgctgggtcncaggctccgagggagggctggagtgggtgccgcatcaagaggagatagtggaaggggagcgacagactacgctgcaccgtgaagaggcagatttaccatgtacaagagatgattacaacaaagtanaggtntaatctagacaaatgaaaccagccgtagaaacgaccgagacacacgacctatttactatagtaacaaattcgaaagtacggaggggggaaacgggggtaaattcgggggcaaggggaaccctgggtcncgtcttacgtcgaacgtccc

SEQ ID NO: 316619 - DNA, 557 bp, Homo sapiens
  misc_feature: GZ8MTXP01DT7JZ.19.10.A10.1.454.CMB.2.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (394)..(394): a, c, t, g, unknown or other
  misc_feature (394)..(394): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttctgacgcagtctccaggcaccctgtctttgacccctggggaaagngcccaccctctcctgcagggccataagagtgttgacagcctaccttnttgcctggtaccagcagagacctggccaggcctcccaggcctcctgttanggtcnccgtccaccgagggcccagtcggccacgtcccccgataggttcaggtggctagtgtgtctgggactagtactcactctcaaccatcagcagactggacnctagaagtattgctagtagtattactgtacaacgtatatgagtgacgtctaccgtcggtggtgtactagttcggaccgtaaggggtaccgtaaggttaagaaagttacgaaacgttagtggtgcgttgctaaccgtattcgtcgtcttctaacgttcctcccg

SEQ ID NO: 316620 - DNA, 586 bp, Homo sapiens
  misc_feature: GZ8MTXP01DJCD0.19.10.A10.1.454.CMB.2.raw
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgctggttcgcaggctcgagggagggctggagtggtgccgcatcaagaggagatagtgaagggggagcgacagactaccgctgcaccgtgaagngcagatttacatgacaagagatgattcaanaaagtcagtntatctgacaaatgaacaggcctagaacgaaccgaggactacagacctaatttactattagtaaacaaagtgaaagtacggaggggggtaaacgggggaaaatttcgggggaccaacgggggtaaccccgtgggttccgacccggtcgttacgtccgaacggtccccg

SEQ ID NO: 316621 - DNA, 602 bp, Homo sapiens
  misc_feature: GZ8MTXP01A1JOA.19.10.A10.1.454.CMB.2.raw
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (460)..(460): a, c, t, g, unknown or other
  misc_feature (460)..(460): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagtttggatttttcctttctgctattttaaaaggtgtcctgtgtgaggtgcgcctggtggagtcgtgggggaggcgtggtccaggccccggggggtccctgagactctcctgtagaagttatggattcaacttcgctagcggctggctgtgcgtgggttcgccaggctccgaggggaagggctgggaggtgggtggccgcatcgaagaggagatagaggaagggggagcgacagactaccgctgccgaccgtgaagaggcagtatttacatgtacaaganatgattacaanaaagtacagtgtatcagacaaagtgaaacnggacctaggaaacacccggaagacacagacctaatttaacgattacgaaacaaattggaaattacgggaggggggaaacggggtaaaattcgggaacggaccgaagggtacccctgggtctccgttccgtcgttccgaaccg

SEQ ID NO: 316622 - DNA, 581 bp, Homo sapiens
  misc_feature: GZ8MTXP01BIO47.19.10.A10.1.454.CMB.2.raw
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggtcnccaggctccgagggagggctggagtgggttggccgnatcaagaggagatatggaagggggngcgacagactacgctgcacccgtgaagaggcagactttaccatgtacaaagtagatgattcaacaaagtacagtgtatctagacaaagtnaaacnggaccctaggaacgaccgagacacagtaccatttactattgtaaacaaattgaaatacggttagggggaacgggggtaaaattcgggggaccaggggaaccctgggtcctccgtcttcgtcaacggtcccc

SEQ ID NO: 316623 - DNA, 615 bp, Homo sapiens
  misc_feature: GZ8MTXP01A0QUC.19.10.A10.1.454.CMB.2.raw
  modified_base (427)..(427): a, c, t, g, unknown or other
  misc_feature (427)..(427): n is a, c, g, or t
  modified_base (455)..(455): a, c, t, g, unknown or other
  misc_feature (455)..(455): n is a, c, g, or t
  modified_base (601)..(601): a, c, t, g, unknown or other
  misc_feature (601)..(601): n is a, c, g, or t
  modified_base (607)..(615): a, c, t, g, unknown or other
  misc_feature (607)..(615): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgcaaatgaacagcctagaaagaccgaggacacagcctatttactatttgtaacaaatgaaatacggtaggggggaacgggggtaaaagttgggggaccaggggaaccctggtccctccggtctcgtcacgccctccaaccgaacggggccccacgttcccggtccttccccccgngggcccgtccccgtgccctccgaggacnccacccgtccgagacgccaccgacggcccggcccgtggggggcctcggcccgttcgggtaccgaaacgggcccttaccgttaccccgaggaacggtacgtaccgtgggaacggtccggggacgtcgggcgaaacggggcgttacgngttagnnnnnnnnn

SEQ ID NO: 316624 - DNA, 584 bp, Homo sapiens
  misc_feature: GZ8MTXP01DL6X2.19.10.A10.1.454.CMB.2.raw
  modified_base (441)..(441): a, c, t, g, unknown or other
  misc_feature (441)..(441): n is a, c, g, or t
  modified_base (572)..(572): a, c, t, g, unknown or other
  misc_feature (572)..(572): n is a, c, g, or t
  modified_base (576)..(584): a, c, t, g, unknown or other
  misc_feature (576)..(584): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtaatctgacaaatgaacagcctagaagaccgaggacacagcctaatttactattagtaacaaatgaaagtacggtagggggaacgggggaaaagttcgggggaccagggacctggtccctccgtctcgtcacgccctccaaccgaacgggcccagtccggtcccttccccgtggcccgtccctgcctcgaggcnccacccgtcgagacgccacgacggtccggccccgtggggggccctggcccgtgggtaccaaacggtaccttacgtaccccgaaggtacgtacgtaccgtggaacggcgggactgggacgaagggccgaagngagnnnnnnnnn

SEQ ID NO: 316625 - DNA, 596 bp, Homo sapiens
  misc_feature: GZ8MTXP01A0ACN.19.10.A10.1.454.CMB.2.raw
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (586)..(586): a, c, t, g, unknown or other
  misc_feature (586)..(586): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctggttcgccaggctcgagggagggctggagtggtgccgnatcaagagagatagnggaaggggagcganagactaccgctgcaccgtgaagaggcagactttaccatgtacaagagtatgattacaacaaagtctaagtagtatctagacaatagaacaggacctaggaacgaccgagacacgagaccctattaacctattacgaactaaagtcgaaagtacgggttaagggggtaaacggggggtaaagttacgggggccgaacggggtaaccctgggtcctaccgtcgttaccgtcnccggtaaccc

SEQ ID NO: 316626 - DNA, 941 bp, Homo sapiens
  misc_feature: GZ8MTXP01DR64R.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtatttttcctttctgcttaattttaaaaggtgtcctgtgtgaggtgcgccgtggtggagtcggtgggggaggcggtggtccgaggccccggggggtccctgagactctctgtagtaagttatggtattacaacttcgctaggcggcgtggctggtgtcgtcgggttccgccgaggccgtaccggaaggggaaggggcgtagggaggttggggttcggccgtcaagtacgaaaggaggaagtaagtaaggtagggaaagggggaggacgaacgacgacctaccgcgtacgacccgacccggtaggaaacggacggcgaaagttaaacttttaacccgaagttacggtaacgtaaaagggaagtaagtttaacgtaactttaaaccgaaaacgttaaaaaggttaacgtaagggtttagttaaacttaccgaaggaaaaacctaaaagttaacggaaaaacccgtacgggggttaaccccgaaaaggggaaaacccggaaacccgggaaacgggaaaccccaaaccggtaaacccggttaaaccccttttaaaattttttaaaacccgttaaagttttaaacgggtaaaaaacccttaaaaaagggtttaacccgggttaaaaagggggtttaaaaccccggggggttaaagggggggggggtaaaaaaaccggggggtttaaaacggggtttacccggggggaaacccgggttaaaacccggggttaaccccggttcggttaaccccggttaccccggttacgttaccccgggtaacaaccccggtaacccccccgg

SEQ ID NO: 316627 - DNA, 624 bp, Homo sapiens
  misc_feature: GZ8MTXP01AJSSC.19.10.A10.1.454.CMB.2.raw
  modified_base (193)..(193): a, c, t, g, unknown or other
  misc_feature (193)..(193): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtcttgacccctggggaaanagcccaccctctcctgcagggccgataagagtgttgacagctacctttcttgcctggtaccagcagagaccgtggcccaggcctcccgaggtccttcccgttcggtttagtcgggtcgcccgtccaccgaggggcccacgtggccacgtccccgataggttcaggtggctaggtgtgtcgtcgggacagtactcactctcaaccntccagcagactggacncctagaagtntttgctagttagtattacgtcgtacaacgtattagtagagtgacgtcctaccgttcggtggtacggtacgtaggtttcgggaccgtaacggggtaaccgtaagggttaacggaaacgttacgtaaaacggttacgttaggtcggacgttcggacctaacctagttccgttcgttccttcgtaaccttcccgttaaccccg

SEQ ID NO: 316628 - DNA, 630 bp, Homo sapiens
  misc_feature: GZ8MTXP01A4GKO.19.10.A10.1.454.CMB.2.raw
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaggtgtcctgtgtgaggtgcgcctggtggagtcgtgggggaggcgtggtccaggcccggggggtcctgagactctcctgtagaagttatggattcaacttcgctagcggctggctgtgcgtggtcgcaggctcgagggagggctggagtggtgccgnatcgaagaggagatagtaggaagggggagacganagactaccgctgccacccggtgaagaggcagtatttaccagtgtacaaagagatagaattacaaacgtaaaagtacaaggttagtaactcgttaggaactaaaagtagaaaccgaggggacctaggaaacggacccggaagaaccacgagaccctatttaactattagtaaactaaagtgaaagtacgggttagggggaaacgggggtaaaagttcgggggacgaacgggtaacccgtgggtcctaccgtcgttccgtaacgcgtaaccccg

SEQ ID NO: 316629 - DNA, 587 bp, Homo sapiens
  misc_feature: GZ8MTXP01CYEFP.19.10.A10.1.454.CMB.2.raw
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (579)..(587): a, c, t, g, unknown or other
  misc_feature (579)..(587): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgccacccgtgagaggcagatttaccatgtcaagagatgattacaacaaagtacagttgtatctgacaaatgaacagcctagaagaccgaggacacagcctatttactattgaacaaatgaatacggtagggggaacgggggaaatgggggaccaagggaccctggtccctccgtctcgtcacgccctccaaccgaacgggcccctagtccggtcccttccccccgtgggccctccctgacctcccgaggaccgccaaccgtccgagacgccacgcggtccggccccgtggggggaccttcggccttacggggaccaaacgggtcccttaccgtaccccgagacgtagtacgtggaacggcgggctagggccgaagggccngttangnnnnnnnnn

SEQ ID NO: 316630 - DNA, 689 bp, Homo sapiens
  misc_feature: GZ8MTXP01CG3GL.19.10.A10.1.454.CMB.2.raw
  modified_base (325)..(325): a, c, t, g, unknown or other
  misc_feature (325)..(325): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttattttaaaaggtgtcctgtgtgaggtgcgcctggtggagtcgtgggggaggcgtggtccgaggcccgggggtcctgagactctcctgtagaagttatggattcaacttcgctagcggctggctgtgcgtggtcgcaggctcgagggaggctggagtggtgcgnatcaagagagatagtaggaaggggagcgacgagactaccgctcgcgaccgtgaagacggcagtactttaccatagtacaagagtatgtaactacaaagtaaagtacgtaagttacgtactacgtacgaactaaagtacgaaacgtacgggtacgaaaggaaaccgaaccggaagaacctacgtaccgtacctttaatttaaccgttaaattacggtaaaactaaaggtttaacggaaaacggttaacgggggttaaacgggggggtaaaaccgggggtaaaggttcccgggggaaccgttaaaccggggttaacccgtcgggttaacccgttccggtacgttaccgtccgaacccgtaaccccg

SEQ ID NO: 316631 - DNA, 615 bp, Homo sapiens
  misc_feature: GZ8MTXP01E10BY.19.10.A10.1.454.CMB.2.raw
  modified_base (286)..(286): a, c, t, g, unknown or other
  misc_feature (286)..(286): n is a, c, g, or t
tcagtactctcgtgcacgaccggtgctcgatttagcgtcgatctcagggggagctgctcagttaggacccagagggaaccatggaaacccagcgcagcttctcttcctcctgctactctggctcccagatagcaccggagaaattttctgacgcagtctccaggcaccctgtctttgacccctggggaaagagccaccctctcctgcagggccgataagagtgttgacagcaccttcttgcctggtaccagcagagacctggccaggctcccgagcctctcgttanggtcgccgtccacgaggcctacgtcggcacgtcccccgagtacggtttcaggtcggctagtggtcgtcgtaggaccagtaccttcactctacccaacgtatcagctagcgtggactctagaagttattgactagttagttaattactacgtaacaagtatatagtacggtcgacgtccgtaccgtcggtggtacgtacgttaggtaccgaccggtaagggaaccgtaaggttaacgaaacgttaaccgaaaagttacgtcggtacggttcttccggacctaaccgtacgttccgttacgttccttacctaaccttccccgttaaccccg

SEQ ID NO: 316632 - DNA, 600 bp, Homo sapiens
  misc_feature: GZ8MTXP01AWFK5.19.10.A10.1.454.CMB.2.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (448)..(448): a, c, t, g, unknown or other
  misc_feature (448)..(448): n is a, c, g, or t
  modified_base (496)..(496): a, c, t, g, unknown or other
  misc_feature (496)..(496): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccggggggtccctgagactctcctgtagaagttatggattcaacttcgctagcggctggctgtgctggtcnccaggctccgagggagggctggagtggtgccgcagtcaagagagatagnggaaggggngcgacagactaccgctgcacccgtgaagaggcagtactttaccatgtacaagagatgaattcaacaaagtctagtgtatctagacaaagtgaaacncggacctaggaacgacggagactacgacgacctatttacattacgaanaaatgaaaggtacggagggggtaaaccgggggtaaaagttcgggggaccgaacggggtaaccccttgggtaacctccggtcgttaccgtcgttaacgtcccccg

SEQ ID NO: 316633 - DNA, 601 bp, Homo sapiens
  misc_feature: GZ8MTXP01BQ5UW.19.10.A10.1.454.CMB.2.raw
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
  modified_base (557)..(557): a, c, t, g, unknown or other
  misc_feature (557)..(557): n is a, c, g, or t
  modified_base (590)..(590): a, c, t, g, unknown or other
  misc_feature (590)..(590): n is a, c, g, or t
  modified_base (593)..(601): a, c, t, g, unknown or other
  misc_feature (593)..(601): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctgggagtgggttggccgcatcaagaggagatatgaaggggaggcgacagactacgctgcacccgtgagaggcagatttaccatgtacaagagatgattcaacaaagtacagtgtatctgacaaatgaacagcctagaacgaccgaggacacagcctaatttactattagtaacaaatagaagtacggtaggggggaaacggggggtaaaagttcgggggaccgaaggggtaaccccgtgggtcccctccggtctaccgtcacgtaccctacccaaccgaacgggcccacgtcccgggtcccttcccccgtgggcccnccctgccctcgaggacnccaccgcgagcgcacgcggccggtccgtgggggactcggccgtaggtaccaaacggtcccttaccgtacccgaggtagtacgtacggnggaacggtcgggcgaggacgaacgggcttacgngcnnnnnnnnn

SEQ ID NO: 316634 - DNA, 613 bp, Homo sapiens
  misc_feature: GZ8MTXP01CUXYL.19.10.A10.1.454.CMB.2.raw
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagttggcctgagttggattttcctttctgctattttaaaaggtgtcctgtgtgaggtgcgcctggtggagtcgtgggggaggcgtggtccaggcccggggggtcctgagactctcctgtagaagttatggatccaaacttcgctagcggctggctgtgctgggtcnccaggctcgagggagggctggagtggtgccgcatcaagaggagataagtggaagggggagcgacagactaccgctgcacccgtgaagaggcagtacttaccatgacaaaganatgaattacaataaacgtacaagttgtaatctagaacaaatacgaaacagacccgtaggaaacgaccgaacggaacacgagtacctatttacgtattagtaaacaaatagaaagttacgggagggggaaacgggggtaaagttcgggggaccgaacggggtaaccctgggttcccgtccggtcgttaccgtccgaacggtaaccccg

SEQ ID NO: 316635 - DNA, 627 bp, Homo sapiens
  misc_feature: GZ8MTXP01B3MIT.19.10.A10.1.454.CMB.2.raw
  modified_base (576)..(576): a, c, t, g, unknown or other
  misc_feature (576)..(576): n is a, c, g, or t
  modified_base (614)..(614): a, c, t, g, unknown or other
  misc_feature (614)..(614): n is a, c, g, or t
  modified_base (618)..(625): a, c, t, g, unknown or other
  misc_feature (618)..(625): n is a, c, g, or t
  modified_base (627)..(627): a, c, t, g, unknown or other
  misc_feature (627)..(627): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaacagcctaggaacgaccgaggacacagcctatttactattagaactaaagtgaaagttacggtagggggggaacggggggtaaaagttcgggggacctaacgggggaaccctgggtacccctccggtctcggtcacgccctacccaaccgaacgggcccagtccgggtccctacccccgtggcccgtccctgcctaccgagggcaccgtaaccctccggacgacgccaacgtccggcccgggtcccctggggggcttcggggacctacgggtaccaaaccgggtcctaccgttaccccgaaggagtacgttaacgnggaacgggcgggactcggggacgaaacggggccagttnaggnnnnnnnngn

SEQ ID NO: 316636 - DNA, 837 bp, Homo sapiens
  misc_feature: GZ8MTXP01CU0DV.19.10.A10.1.454.CMB.2.raw
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
tcagtactctcgtgcacgaccggtgctcgatttagcgtcgatctcaggaggggagaggagtcccagccttggggttcccgagtgttttcgttcagtgatcaggactgaacacgtaggactcaccatggagtttggcctgagttggattttcctttctgctattttaaaggtgtcctgtgtgaggtgcgcctggtggagtcgtggggagcgtggtccaggcccgggggtcctgagactctcctgtagaagttatggattcaacttcgctaggcggctggctgtgctgggtcnccgaggctcgagggagggctggagtggtgcgnagtcaagagganagtagtagggaaagggggaggcgaacgaggaaccccttacggacgtcgacccgaaccccggtggaacgggaaggacctaaacggggttaaactttttaaccccgaaagtttacggttaaaccgaaaagggtagtaaagtttaccgggaaaacttttacccgaaaacttaaaaaagggttaaccgtaagggttttacgttaaattccgggttaaaacgaaacgtaaaacgtaaacgtaaaccggtaaacggtaaccggtaaacggaaacgggaaaccggaaaccggaaaccgaaaccgtaaaccgtaaccgttaaacgtttaaacgtttaaacgtttaaacgttaaaacgttaaaacgttaaaggttaaacggttaaacggggtaaacggggggtaaaacgggggttaaaacgggggttaacgggggttaaccggggtaaaccgggtaaccgggttaaccgggttaccggttaccggttaccgttaaccgttaaccgtaaccg

SEQ ID NO: 316637 - DNA, 592 bp, Homo sapiens
  misc_feature: GZ8MTXP01ELDZ3.19.10.A10.1.454.CMB.2.raw
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctaattttaaaaggtgtcctgtgtgaggtgcgcctggtggagtcgtgggggagcggtggtccgaggcccggggggtccctgacgactctcctgtagaagttatggattcaacttcgctagcggctggctgngctggtcncaggctcgagggagggctggagtgggtggccgcatcaaagaggagatagtaggaagggggagcgacagactaccgctgccacccgtgaaacgagcagtactttaccatgaacaagagatnaatacaaataaaggtcaaggtntatcagaacaaagtnaaaccnggtaccaggaaaccnccggtaagaccacganaccttaattaccgtaattcaaacaaattgaaagtacgggttagggggaacggggtaaattcgggggacacgggaaccctgtcctccgcttctcgcgaaccc

SEQ ID NO: 316638 - DNA, 661 bp, Homo sapiens
  misc_feature: GZ8MTXP01BE5EV.19.10.A10.1.454.CMB.2.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (475)..(475): a, c, t, g, unknown or other
  misc_feature (475)..(475): n is a, c, g, or t
  modified_base (651)..(651): a, c, t, g, unknown or other
  misc_feature (651)..(651): n is a, c, g, or t
tcagtactctcgtgcacgaccggtgctcgatttagcgtcgatctcaggggggggagaggagtcccagccttggggttcccgagtgttttcgttcagtgatcaggactgaacacgtaggactcaccatggagtttggcctgagttggtatttttcctttctgtcttaattttaaaaggtgtcctgtgtgaggtgcgcctggtggagtcgtgggggaggcgtggtccgaggccccgggggtcctgagactctcctgtagaagttatggtattcaacttcgctagcggctggctggtgctggtcnccgaggctcgagggagggctggagtggtgccgnancaagagagatagnggaagggggagcganagactaccgctcgaccgaccgtgaaacgagggcaagtactttaccagttgaacaaagagtatgaaacttacgaaaacgtaaaagttcaaggtttacgtaatcctaagaanaaaagtgaaacacggggacccgtaaggaaaccgaacccggaaggaaaccctacgaactaaccttatttaactaagttaacgaaactaaagtagaaaggttacgggaaggggggtaaacggggtaaagttcggggaccgaacgggtaacctcgggtccttccgtacgttcgtaaccncggtaacccc

SEQ ID NO: 316639 - DNA, 577 bp, Homo sapiens
  misc_feature: GZ8MTXP01D3FTK.19.10.A10.1.454.CMB.2.raw
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagctaccttnttgcctggtaccagcagagacctggccaggcctcccgaggctccttcgttangggtcnccgtccaccgagggcccacgtcggccacgtcccccgagtacggtttccaaggtcgggactaggtcgtgtccgtggggacctaggaccttcactcctacnccatccagccagctgggacnctagagtatttgctagttgtattacgtgtacaagatatgagtgagtccaccgttcgtcggtgactagttcggacgaggggtaccaagggttaagaagttacgaaacgttacgtggtggacgttcgacctaactatcgtctcttactaacgttcctccccg

SEQ ID NO: 316640 - DNA, 747 bp, Homo sapiens
  misc_feature: GZ8MTXP01CN0L5.19.10.A10.1.454.CMB.2.raw
  modified_base (707)..(707): a, c, t, g, unknown or other
  misc_feature (707)..(707): n is a, c, g, or t
  modified_base (738)..(747): a, c, t, g, unknown or other
  misc_feature (738)..(747): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaaggggctggagtgggttggccgcatcaagaggagatatggaaggggaggcgacagactacgctgccaccgtgagaggcagtatttacatgtacaagagatgattacaaactaaagtacagttgttatcgtagaactaaagtacgaaacacgaccgtaggaaacggaaccggaacggaccaaccgacgtaaccctttaaattttaaacgttaatttaacgtaaactaaaagttacggtaaacggttaacgggggtaaggggggggggaaaaccggggggtaaaaggtttccgggggaacccggtaaacgggggtacccgttcgggttacccctcccggttcgtacccgtcgaccgtaacccctacccgaaccggaaccgggccccttacggttccccgggttccccttcccccggcgggcccctcccgtgacccgtacggacggacccacccgtacccgcggaaagcccgtacgaacccgccgggggtccccgtcccggttggggggcccgttacggtacccggttacggaaaccgtaaaccggtcccttaacccgtacccgaggacgtagtaccggngggaacgggtcggacgcgacgacggcagagnnnnnnnnnn

SEQ ID NO: 316641 - DNA, 594 bp, Homo sapiens
  misc_feature: GZ8MTXP01BTDJG.19.10.A10.1.454.CMB.2.raw
  modified_base (454)..(454): a, c, t, g, unknown or other
  misc_feature (454)..(454): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgagggaggggctggagtgggttggccgcatcaagaggagatagtggaagggggaggcgacagactaccgctgcacccgtgaagaggcagatttaccatgtacaaagagatgattacaacaaagtcaagtgtaatctagacaaatgaaacnggcctagaacgaccgagaccacagacctatttactattagaacaaatgaaagtacggttagggggaaacgggggtaaagttcgggggccaacgggggtaacccgtggtaaccttcccggtcttccgtccgaacgtccccg

SEQ ID NO: 316642 - DNA, 737 bp, Homo sapiens
  misc_feature: GZ8MTXP01BY85Y.19.10.A10.1.454.CMB.2.raw
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtcctgagactctcctgtagaagttatggattcaacttcgctagcggctggctgtgcgtggtcgcaggctccgagggagggctggagtgggtggccgnatcaaggaggagatagtaggaagggggagcganagactaccgctgcacccgtgaagaggcagtactttaccatgtacaaagagtatgaattacaacgtaaaagtacgaagttagttaactcgttaggaaaccaaaagttcgaaaacccaagggggaccccgttaaggaaaaccggaaccccggaagggaacccaaaccgaacggtaaccccttaatttttaaaccgtaatttaacggtaaactaaaaagttcggaaaacgggttaaaccggggttaagggggggggtaaaacccggggggggtaaaagttttccgggggggaaccccggttaaacgggggtaaacccccgttgggtttaaccccgtacccgggtttccgttaccggggttcccaaacggtcccccccgg

SEQ ID NO: 316643 - DNA, 613 bp, Homo sapiens
  misc_feature: GZ8MTXP01AT3TI.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggtcgccaggctccgagggagggctggagtgggtggccgcatcgaagaggagatagtggaagggggagcgacagactacgctgcacccgtgaagaggcagtatttaccatgtacaagagatgaattcaacaaagtacagtgtatcgtagacaaatgaaacaggcctaggaaacgccgaaggaccacgagacccttaattactatttacgaaactaaagtcgaaagtacgggttaaggggggaaaccgggggtaaaagttcggggggaccaacggggtaaccctggggttaaccctccgggtcttaccggtccaacggtcccc

SEQ ID NO: 316644 - DNA, 646 bp, Homo sapiens
  misc_feature: GZ8MTXP01AUEQX.19.10.A10.1.454.CMB.2.raw
  modified_base (332)..(332): a, c, t, g, unknown or other
  misc_feature (332)..(332): n is a, c, g, or t
  modified_base (421)..(421): a, c, t, g, unknown or other
  misc_feature (421)..(421): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgtctattttaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggaagggctggagtgggtggccgnagtcaaggaggagatagtaggaagggggagacgacagactaccgctgccacccggtgaaaggaggcagtactttaccatgtacaagganatagaattacaaactaaaggtactaaggtgtaatccgtagacaaaatcgaaacacgggcctaaggaaacgacccgaaggacacgagtacctatttaacgtatttgaaactaaagtgaaagttaccggttaggggggaaacgggggtaaaagtttcgggggccgttaaacgggggaacccttgggtcccgttacccggtcgttaccgttccgaacggttaaccccc

SEQ ID NO: 316645 - DNA, 635 bp, Homo sapiens
  misc_feature: GZ8MTXP01EXJI1.19.10.A10.1.454.CMB.2.raw
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgtcttaattttaaaaggtgtcctgtgtgaggtgcgctggtggagtcgtggggaggcgtggtccgaggcccgggggtcctgagactctctgtagaagttatggattcaacttcgctagcggctggctgtgcgtggtcgcgaggctcgagggagggctggagtggtgcgnatcaagaggagatagnggaaggggagcgacagactaccgctgccacccggtgaacgagcaagtactttaccgatgacaagagatacgattacaaacgtaaaagtctaagttagtatcgtagaactaaaatcgaaacagggacctaaggaaacgaaccgaggaacacgacgtaaccttatttaacttagttaacgaaataaagtggttaaacgtacggggttaaggggggaaaccggggtaaaagttcgggggaccgttaacggggtaaccccgtggtaaccgttcccggtgttccgtcgaaccgtcccg

SEQ ID NO: 316646 - DNA, 673 bp, Homo sapiens
  misc_feature: GZ8MTXP01BTV89.19.10.A10.1.454.CMB.2.raw
  modified_base (619)..(619): a, c, t, g, unknown or other
  misc_feature (619)..(619): n is a, c, g, or t
  modified_base (662)..(662): a, c, t, g, unknown or other
  misc_feature (662)..(662): n is a, c, g, or t
  modified_base (664)..(665): a, c, t, g, unknown or other
  misc_feature (664)..(665): n is a, c, g, or t
  modified_base (667)..(673): a, c, t, g, unknown or other
  misc_feature (667)..(673): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatggaaggggaggcgacagactacgctgcacccgtgagaggcagatttaccatgtacaagagatgattacaacaaagtacagtgtatctgacaaatgaacagcctagaacgaccgagacacagacctatttactattagtaacaaatagaaagtacgggtaggggggaaacgggggtaaagttcgggggaccgacggggaaccctggtcccctccggtctccgtcacgtacccctacccgaaccgtacgggcccctacgttcccggttccccttcccccggtcgggccctccccgttgcctaccccgagggaccacccgaaccccgtccggaagacgtacccgaccgtacgggcccgggtcccccgtagggggggggtccttcggacccgtttcggggaacccgaaaccgggtaccctttaacccgttaccccgaaggtaacggtacggttacgnggaacgggtccggggttactcgggacgaaacggggcaacgagngnngnnnnnnn

SEQ ID NO: 316647 - DNA, 631 bp, Homo sapiens
  misc_feature: GZ8MTXP01DLSVJ.19.10.A10.1.454.CMB.2.raw
  modified_base (297)..(297): a, c, t, g, unknown or other
  misc_feature (297)..(297): n is a, c, g, or t
  modified_base (504)..(504): a, c, t, g, unknown or other
  misc_feature (504)..(504): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagttggcctgagttggtattttcctttctgctattttaaaaggtgtcctgtgtgaggtgcgcctggtggagtcgtgggggaggcgtggtccgaggccccggggggtccctgagactctcctgtagaagttatggattcaacttcgctagcggctggctgtgctgggtcnccaggctccgagggaaggggctggagtgggttggccgcatcaagaggagatagtggaagggggaggcgacagactacgctgcacccgtgaagaggcagtatttaccatgtacaaagagatgaattacaacaaagtacagttgtaatctagacaaatgaaacagggccctaggaaacgaccgaggacacgacgcctaatttacattanaactaaaatggaaagtaaccgggaggggggtaaacggggggtaaagttacgggggcccgttaaacgggggtaaccccgttcggggtccttacccgggtccttaccgggtccgaaccggtaacccccg

SEQ ID NO: 316648 - DNA, 573 bp, Homo sapiens
  misc_feature: GZ8MTXP01AI9CJ.19.10.A10.1.454.CMB.2.raw
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
tcagtactctcgtgcacgaccggtgctcgatttagcgtcgatctcaggggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccgggggtccctgagactctcctgtagaagttatggattcaacttcgctagcggctggctgtgctggtcgcaggctccgagggagggctggagtgggtggccgcatcgaagaggagatagtggaagggggagcgacagactaccgctgccacccggtgaagaggcagactttaccatgtacaagtagatgaattacaacaaagtacagtgtatctagacaaatgaaacnggaccgtagaacgacgagacanagacctattactatnaacaaatgaagtcggagggggaaacggggtaaattcgggggcaggggtaaccctggtcctccgtcgttcgtcaacgtccccg

SEQ ID NO: 316649 - DNA, 575 bp, Homo sapiens
  misc_feature: GZ8MTXP01BEC4D.19.10.A10.1.454.CMB.2.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (566)..(566): a, c, t, g, unknown or other
  misc_feature (566)..(566): n is a, c, g, or t
  modified_base (568)..(575): a, c, t, g, unknown or other
  misc_feature (568)..(575): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagtatttaccatgtacaagagatgattcaacaaagtacagtgtatctgacaaatgaacagcctagaagaccgaggacacagcctatttactattagtaacaaatagaaagtacggtaggggggaacggggggtaaagttgggggaccaaggggtaaccctggtccctccgtctcgtcacgccctacccaaccgaaacgggccctacgtccggtcccttcccccgnggcccnccctgcctccgaggacnccacccgtcganacgcacgtgcccggccgtgggggctcgccgtggtacaaacggtctaccgtcccgagtagtacgtcgtggaaggcgggcgtggaccgaagggcttcgagngnnnnnnnn

SEQ ID NO: 316650 - DNA, 707 bp, Homo sapiens
  misc_feature: GZ8MTXP01B0QRW.19.10.A10.1.454.CMB.2.raw
  modified_base (329)..(329): a, c, t, g, unknown or other
  misc_feature (329)..(329): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtctgtgtgaggtgcgcctggtggagtcgtgggggaggcgtggtccgaggcccggggggtccctgagactctcctgtagaagttatggattcaacttcgctagcggctggctgtgcgtgggttcgcaggctccgagggagggctggagtgggtgcgnatcgaagaggagatagtaggaagggggagacgacgagactaccgctgccacccgtgaagagcagtattacatgtacaagagatgaattacaacgtaaagtactaaggtgttaaatccgtagaactaaaagtagaaaccgagggacccgttaagggaaaccggaacccggaaagggaacccaacgtaacggtaacccttaattttaaccgtaatttacggtaaaactaaaaggttaggttaaaacggttacgggggttaacggggggggaaaacggggggtaaaaggttccggggggaaccgttaaaccggggggtaaaccccgttcggggtaaccccgttccggtcccggttaccggtccgttaaccggtaacccccg

SEQ ID NO: 316651 - DNA, 669 bp, Homo sapiens
  misc_feature: GZ8MTXP01A1EPQ.19.10.A10.1.454.CMB.2.raw
  modified_base (318)..(318): a, c, t, g, unknown or other
  misc_feature (318)..(318): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttattttaaaaggtgtcctgtgtgaggtgcgcctggtggagtcgtgggggaggcgtggtccaggcccggggggtccctgagactctcctgtagaagttatggattcaacttcgctagcggctggctgtgcgtggtcgccaggctccgagggagggcgnggaggtgggtcggccgcagtcaaaggaggagataagtgggaaagggggaggacgacgagacctacccgctcgaccgacccgtgaagaggcagtaactttaccatgtacaaagagatagtaattaccaaacgtaaaagtacgaagttagtactacgtagacctaaaagtgaaaccagggacctaggaaacgacccgaaggaccaaacgcgtacccttaatttactaatttacgaaactaaagtagttaaaggtacgggacggggggtaaaacggggtaaacgttcgggggaacccaacgggggtaaccccgtgggtcccttccggtccgttacgtccgaaccgtaacccccg

SEQ ID NO: 316652 - DNA, 626 bp, Homo sapiens
  misc_feature: GZ8MTXP01ATN4G.19.10.A10.1.454.CMB.2.raw
  modified_base (374)..(374): a, c, t, g, unknown or other
  misc_feature (374)..(374): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctagaagaccgaggacacagccatttacattgtacaatgaatacgtgggggacgggggaaaagttggggaccaggggaaccctggtcctccggtctcgtcacgccctcccnccgaaacgggccccatccggttctcccccgtggcccgccctgcctccgacggacgccacccgtccgaagacgccaccgacgccgggtcccctaggggggggccttcggacccgttgggtaccaaagggtcccttaacccgtttacccgaccggaagtaacggttaccgtgggaacgggtccgggggttctaacgggggcccgtaaaagggggccccgttaacgttacgttaacggngngngngngncgngng

SEQ ID NO: 316653 - DNA, 623 bp, Homo sapiens
  misc_feature: GZ8MTXP01A5M7A.19.10.A10.1.454.CMB.2.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
tcagtactctcgtgcacgaccggtgctcgatttagcgtcgatctcagggggcagagctctggagaagagctgctcagttaggacccagagggaaccatggaaaccccagcgcagcttctcttcctcctgctactctgctccagatagcacggagtaatttctgacgcagtctccaggcacctgtcttgacccgtgggaaancgccacctctcctgcgagggccaataagagtgtgacagctaccttnttgcctggtaccagcagagaccgtggccacggcctcccgaggtcccttcgtcgtttancggtcgccgtccaccgnggcccacgtcggaccacgtccccgagtacggttccaggtgcgtagtggtcgtcgtggggaactaggtaccttccacttccgactacccatcgacgaccaggacgtggaacgtcctaaggaagttagtttcgaacttagggttagttaacgttacgtagtaccgaaagtatacgttgaattcggtaacgtcctaaccgttcggtggtaaggtaccttagggtttcgggaccggtaaaggggtaccgttaagggttcaaacggttaacgaaacgtaacgtgggtacgacgttgaaccctaacg

SEQ ID NO: 316654 - DNA, 609 bp, Homo sapiens
  misc_feature: GZ8MTXP01BYF1L.19.10.A10.1.454.CMB.2.raw
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (481)..(481): a, c, t, g, unknown or other
  misc_feature (481)..(481): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccgaggcccgggggtcctgagactctcctgtagaagttatggattcaacttcgctagcggctggctgtgcgtggttcgccaggctcgagggagggctggagtggtgccgcatcgaagaggagatagaggaagggggagcgacgagactaccgctgcacccgtgaagagcagtaatttaccatgtacaaagagatgaatacaanaaagtcagttntatctagacaaatgaaacnggtacctaggaaacgaccgtaagaccaanacgacctatttaactattagaactaaatgaaagtacgggagggggaaaccggggtaaattcgggggaccttaacggggtaacccgtcgggttccgttacccggtcgttcgtaaccgaacgtaaccccg

SEQ ID NO: 316655 - DNA, 651 bp, Homo sapiens
  misc_feature: GZ8MTXP01ERH0V.19.10.A10.1.454.CMB.2.raw
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgctggtggagtcgtgggggaggcgtggtccgaggcccgggggtcctgagactctctgtagaagttatggattcaacttcgctagcggctggctgtgcgtggtcgcaggctcgagggagggntggagtggtgccgnanacaagaggagagtagtaggaagggggagacgacgagactaccgctcgacgacccgtgaagagcgagtaacttaccatagtacaagagatagaattacaataaacgtagaagttagttaactactaggaactaaagtacggaaacacgggtaccgaaggaaacggaaccgaggaaccaacgagtaacccttaatttaaccttagttaacgaaataaagtacggaaaggtaacggggttaaggggggaaaacgggggttaaacgttcgggggaccgacgggtaacccgtggttccgtaccgtccgttacggaaccgcggtaaccccg

SEQ ID NO: 316656 - DNA, 649 bp, Homo sapiens
  misc_feature: GZ8MTXP01DMK7M.19.10.A10.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
  modified_base (538)..(538): a, c, t, g, unknown or other
  misc_feature (538)..(538): n is a, c, g, or t
  modified_base (639)..(639): a, c, t, g, unknown or other
  misc_feature (639)..(639): n is a, c, g, or t
tcagtactctcgtgcacgaccggtgctcgatttagcgtcgatctcagggggggagaggagtcccagccttgggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtcctgagactctcctgtagaagttatggattcaacttcgctagcggctggctgtgctgggtcncaggctcgagggagggctggagtgggtgccgnatcgaaagaggagatagaggaagggggagacganagactaccgctagccacccgtgaagagcaagtactttaccagtgtacaaaganatgaattaacaaactaaagtcgaagttacttatacgtagaaactaaaatcggaaaaccaggggtccctaaagaaacggacccgaaggtaaccacgactaccctaattttaacgaattacgaanaaaagttggaaagtaaacggggttagggggaaaacgggggtaaagttcgggggaccgaaaggggtaaccccgtgggtaaccttcccggacttcgggaaccngtaacccccg

SEQ ID NO: 316657 - DNA, 617 bp, Homo sapiens
  misc_feature: GZ8MTXP01AP8Q1.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtggcgcctggtggagtcgtgggggaggcgtggtccaggcccgggggtccctgagactctcctgtagaagttatggattcaacttcgctagcggctggctgtgctggttcgccaggctccgagggagggctggagtgggttggccgcatcaaggaggagatagtaggaagggggaggcgacagactaccgctgcacccggtgaagaggcagtatttaccatgtacaagagatagattacaactaaagtactagtgtatctagacaaatgaaacaggccgtagaacgaccggaagacctacgacgacctaatttactattagaactaaagtgaaagtacgggagggggaaaccggggggtaaagttcgggggacccgaacggggtaaccccgtgggtaaccccgttccgtaccgttcgtcccgaacggtccccg

SEQ ID NO: 316658 - DNA, 671 bp, Homo sapiens
  misc_feature: GZ8MTXP01BNR3L.19.10.A10.1.454.CMB.2.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
  modified_base (450)..(450): a, c, t, g, unknown or other
  misc_feature (450)..(450): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggtcncaggctcgagggagggctggagtgggtggccgcatcaagaggagatagtggaagggggngcgacagactacgctgccacccgtgaagagcagtatttaccatgtacaagagatgattacaactaaagtcaagttgtatcgtagacaaatgaaaccnggaccctaggaaacgcccggaaaggaccaacgacgtacccttaaagtttaacctaattacgtaaactaaaagtacgaaacggttaacggggttaagggggggtaaaaccggggggtaaaagtttccggggggaacccgttaaacggggggtaaacccccgttggggttccccgttaaccccgggttaccgttcccgggttaaccgaacccgggtccccccg

SEQ ID NO: 316659 - DNA, 601 bp, Homo sapiens
  misc_feature: GZ8MTXP01CETVA.19.10.A10.1.454.CMB.2.raw
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
  modified_base (593)..(593): a, c, t, g, unknown or other
  misc_feature (593)..(593): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccgggggtccctgagactctcctgtagaagttatggattcaacttcgctagcggctggctgtgctgggttcnccgaggctcgagggagggctggagtgggtggccgcatcaagaggagatagtaggaagggggagcgacgagactaccgctgcacccgtgaagagcagtatttaccatgtacaagagatgaattcaataaagtcagtntatcgtagacaaatgaaactaggcctaaggaaacgacccggaggacctaacgacgtaccctaagttttaactattagtaaacaaatggaaatacgggagggggaaacggggtaaattcgggggacacgggtaaccctgggtcctccgtacgttcgtaaccncggtcccc

SEQ ID NO: 316660 - DNA, 753 bp, Homo sapiens
  misc_feature: GZ8MTXP01B6DG1.19.10.A10.1.454.CMB.2.raw
  modified_base (330)..(330): a, c, t, g, unknown or other
  misc_feature (330)..(330): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagccccgggggtccctgagactctcctgtagaagttatggattcaacttcgctagcggctggctgtgcgtgggtcgccaggctccgagggagggctggagtggttggccgnagtcaaggaggagatagtaggaagggggaggcgaacgagaacctaccgctgaccgacccggtgaaacggacggcaaggtaacttttaacccgattacggtaaccaaaggaaggtattagaaactttacaaaccgtaaaagttaccgaagggtttacttaagttaccgtaggaaacctaaaagttacggaaaaccaggggtacccctaagggaaaacggaccccgggaaaggaacccaacgaacgtacccttaattttaaaccgtaagttttaaccggtaaataaaaagttcggttaaaaaggtttacccggggaagggggggggtaaaacgggggttaaaacggttcgggggaacccgttaacggggtaaccccgttgggttaacccgtccggtacgttaccggttaaccgcggtaacccccg

SEQ ID NO: 316661 - DNA, 782 bp, Homo sapiens
  misc_feature: GZ8MTXP01EQNJK.19.10.A10.1.454.CMB.2.raw
  modified_base (329)..(329): a, c, t, g, unknown or other
  misc_feature (329)..(329): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtggggagcgtggtccgaggcccgggggtcctgagactctcctgtagaagttatggattcaacttcgctagcggctggctgtgcgtggtcgcgaggctcgagggagggctggaggtgggtggccgnatacgaaggaggagatagtagggaagggggaggcgaacgagacgtaccgctcgccgacccgtaggaaacggacggcgtaagtaactttaacccagttacgtaacgaaaggtagtaatgtaaactttaccgaaaacgtaaaaggttacgtaaaggtttagttaacttaccgtaagaaccaaaagttacggaaaacctagggggtaaccccgtaaggggaaaaccggacccggaaaggaacccaaaccgtacgtaacccctttaaatttttaacctaaagtttacggaaaactaaagttaaacgggttaaacgggttaaaccgggggttaagggggggggtaaaaccggggggttaaaaaggttcccggggggaacccgttaaaccggggggtaaccccctttggggtaaccccgtttcccggtcgttacccggttaacccgccggtaacccccg

SEQ ID NO: 316662 - DNA, 619 bp, Homo sapiens
  misc_feature: GZ8MTXP01EFX2D.19.10.A10.1.454.CMB.2.raw
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccgaggcccggggggtccctgagactctcctgtagaagttatggattcaacttcgctagcggctggctgtgctgggttcgccgaggctccgagggaaggggctgggaggtgggtggccgcatcgaaaggaggagatagtggaagggggaggcgacagactaccgctgcaccgtgaagagcagtatttacatgtacaaganatgatcaactaaagtacagtntaatctagacaaaagtcgaaacnggacctaaggaacgaaccgaggaacacagtaccctaatttacctaagtttacgaaataaagtgaaagttacggttaggggggaaacggggtaaaagttcgggggccttaacggggaacccttgggtccttaccgtccgttacgaaccgcgtaacccc

SEQ ID NO: 316663 - DNA, 696 bp, Homo sapiens
  misc_feature: GZ8MTXP01DUO7N.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtatttttcctttctgcttattttaaaaggtgtcctgtgtgaggtgcgcctggtggagtcgtgggggaggcgtggtccgaggcccggggggtcctgagactctcctgtagaagttatggattcaacttcgctagcggctggctgtgcgtggtcgcaggctcgagggagggctggagtggtggccgcatcgaagaggagagtagtaggaaggggaggacgacagactaccgctgccacccgtgaagaggcagtatttaccatgtacgaaagagtatagaacttacaaactaaagtacgtaagttacgtaattcgtagaacaaagtacgaaaccagggaccctaaggaaaaccgaccggaagaacctacgaacgtaacccttaagttttaacctaattacggtaaactaaaaagttggaaacgttaacgggggttaacgggggggaaaaccggggggtaaaaggtttccggggggacccggaaaccgggggttaaccccgttaggggttcccgttaccccgggttcgttacccggttccgaaccggtccccccg

SEQ ID NO: 316664 - DNA, 559 bp, Homo sapiens
  misc_feature: GZ8MTXP01DJ1J9.19.10.A10.1.454.CMB.2.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
  modified_base (549)..(549): a, c, t, g, unknown or other
  misc_feature (549)..(549): n is a, c, g, or t
  modified_base (554)..(559): a, c, t, g, unknown or other
  misc_feature (554)..(559): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagagcagatttaccatgtcaagagatgattcaacaaagtacagtgtatctgacaaatgaacagctagaagaccgaggacacagcctattactatagaacaaatgaaatacggtaggggggaaacgggggtaaagtcgggggaccaacgggaccctggtccctccgtctcgtcacgccctaccaaccgaacgggccctacgtccgtcccttccccgtggcccnccctgcctccgagggcncccaccgtccgganacgcacgacgcccggcccgtgggggctcggcctagggtaccaacggtcctacctacccgagagtacgtacngggaagcgggntagggcaagggcanagttnnnnnn

SEQ ID NO: 316665 - DNA, 566 bp, Homo sapiens
  misc_feature: GZ8MTXP01ARZX7.19.10.A10.1.454.CMB.2.raw
  modified_base (247)..(247): a, c, t, g, unknown or other
  misc_feature (247)..(247): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
  modified_base (556)..(556): a, c, t, g, unknown or other
  misc_feature (556)..(556): n is a, c, g, or t
  modified_base (558)..(566): a, c, t, g, unknown or other
  misc_feature (558)..(566): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggtcgcatcaagaggagatatggaaggggagcgacagactacgctgcacccgtgagaggcagatttaccatgtacaagagatgattcaacaaagtacagtntatctgacaaatgaacagcctagaacgaccgaggacacagcctaatttactattagaacaaatgaaagtacggtagggggaacgggggtaaattcgggggaccaacggggtaaccctggtacccctccgtctcgtcacgccctacccaacgaacgggcccagttccggtccttccccgngggcccaccctgcctccgaggcncaccgtcgagacncacgcggtccgccctgggggctacggcctggtaccaacggtcctaccgtacccagtgacgtacgnggaacgcgggntcggcgaacgggcagttngnnnnnnnnn

SEQ ID NO: 316666 - DNA, 693 bp, Homo sapiens
  misc_feature: GZ8MTXP01CE7IL.19.10.A10.1.454.CMB.2.raw
  modified_base (152)..(152): a, c, t, g, unknown or other
  misc_feature (152)..(152): n is a, c, g, or t
  modified_base (679)..(679): a, c, t, g, unknown or other
  misc_feature (679)..(679): n is a, c, g, or t
  modified_base (684)..(686): a, c, t, g, unknown or other
  misc_feature (684)..(686): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaagggctggagtgggttggccgnatcaagaggagatatggaaggggaggcgacagactacgctgcaccgtgagaggcagtatttacatgtacaagagatgattacaacaaagtacagtgtatctgacaaatgaacagcctagaacgaccgaggacacagctatttactattagtaacaaatgaatacggtagggggaaacgggggtaaagttcgggggaccgaacggggaacccttgggtcccctccggttacgtccgtcacgccccttacccgaaccgaaacgggtcccaaccgttcccggttcccgtccccccgttcggcccgtcccgttccgacgtacccgacgggaccacgaccccgttaccgacgacgaccgaccgccgggttcccgggccccgttcggggggtccgtcgtaccccgtgggtttaaccgaaaccggtacccttaacccgtttacccccaagggtaaacgacgttttaacgcccggtaaggggcccggggcggttcgggaccggaaaccggccggggaaacgttaacgttacgggnagcgnnngngngng

SEQ ID NO: 316667 - DNA, 644 bp, Homo sapiens
  misc_feature: GZ8MTXP01EB3B1.19.10.A10.1.454.CMB.2.raw
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
  modified_base (593)..(593): a, c, t, g, unknown or other
  misc_feature (593)..(593): n is a, c, g, or t
  modified_base (632)..(632): a, c, t, g, unknown or other
  misc_feature (632)..(632): n is a, c, g, or t
  modified_base (636)..(644): a, c, t, g, unknown or other
  misc_feature (636)..(644): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcaccgtgagaggcagtatttaccatgtacaagagatgattacaacaaagtacagtgtatctagacaaatagaaacacgacctaggaaacgaaccgaggaaccacaacgtcctaattttaactatttagtaactaaaatgaaagtacggtaggggggaaacggggggtaaaagttcgggggaccaaggggaccctggtcccctccgtctcgtcacgccctaccaaccgaagggcccctacgttccggttccccttccccgngggccctaccccgtgccctaccgaggaccnccaacccgtccgagacgccacgtcggccgggtccccgtggggggaccttggggaccttcggggtaaccaaacgggtcccttaccgtaccccggagtaaggacgttacggngggaacgggcgggcgtacgggaacgacggggcacgttanacgnnnnnnnnn

SEQ ID NO: 316668 - DNA, 643 bp, Homo sapiens
  misc_feature: GZ8MTXP01CTAQ3.19.10.A10.1.454.CMB.2.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagtaaattttctgacgcagtctccaggcacctgtcttcgaccccgtggggaaancgccaccctctccgtgcgagggccaataagngtgtgacagctaccttcttgcctggtaccagcagacgacctggccagggcctacccgaggtccttcccgttcgtttagtcgggtcgcccgtacccgaccgacggggccctaacgtcgggaccctaaccgtcccccggaagtacgggtttcccaagggtcggcgtaggtcgtacggtcgtcgggactacgtacttcacctctacactatcgagcagtcgtaggacgtcgtagtaagttagtttgacttagttagttaagttacgtaggtacaacggtatagtgtaatcggacgtacccgtaccgttccgggtaggtaacgtaacgttagggtttaccggacggtaaaggggtaccgttaaagggttcgaaacgtaacgaaacgtcgtggtcgctaacgcctaacg

SEQ ID NO: 316669 - DNA, 671 bp, Homo sapiens
  misc_feature: GZ8MTXP01DMYLR.19.10.A10.1.454.CMB.2.raw
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgctattttaaaaggtgtcctgtgtgaggtgcgcctggtggagtcgtgggggaggcgtggtccgaggcccggggggtcctgagactctcctgtagaagttatggattcaacttcgctagcggctggctgtgcgtgggtcgccaggctcgagggagggctggagtggtgccgnatacaagaggagatagtaggaagggggagcgaacgagactaccgctgccgacccgtgaagaggcagtacttaccatgtacaagagatagattacaacgtaaagtactaaggttnttatcgtagaaacaaatacgaaacagggtacccgtaaggaaaacggaaccggaaggaaccaacgacgtaacccttaatttaaccgttaattacgtaaactaaaatacggttaaagtaacggggaaggggggtaaaaccggggggtaaagtttccggggggaccgaaacgggggtaaccccgttacggtcccgttacccggtcgttaccgttccgaaccggtaaccccc

SEQ ID NO: 316670 - DNA, 620 bp, Homo sapiens
  misc_feature: GZ8MTXP01ASUXQ.19.10.A10.1.454.CMB.2.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccaggccccggggggtccctgagactctcctgtagaagttatggattcaacttcgctagcggctggctgtgcgtgggtcgccaggctcgagggagggctggagtgggtgccgnatcgaagaggagatagtaggaagggggagcgaanagactacgctgcaccgtgaagngcagtatttaccatgacaagagtatagattacaanaaagtactaagtgtatcagacaaatcgaacnggactaggaagaccgagacacgagtacctaattcaattacgaactaaagtggaaagtacggggttaggggggtaaaacgggggtaaagttcgggggaacccgttaccgggggtaacccttcggggtaaccttcccgggtccgttacggtccgaacccggtaaccccg

SEQ ID NO: 316671 - DNA, 584 bp, Homo sapiens
  misc_feature: GZ8MTXP01AYUR0.19.10.A10.1.454.CMB.2.raw
  modified_base (334)..(334): a, c, t, g, unknown or other
  misc_feature (334)..(334): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtggttcgccgaggctccgagggaaggggcgtggagtgggtggccgnagtcaagaggagatagtggaagggggagngacagactaccgctgcgacccgtgaacgaggcagtatttaccatgtacaaaganatgtattacaactaaagtacaagttgtaatcgtacgaaanaataagaacgacggacgacgaacgaacgacgacacacactattatatataataatagaagtaggaggggaacggggtaaggttacgggcggacggtaaccgtcggtcgtcgtcgttcgtcgcgtccg

SEQ ID NO: 316672 - DNA, 604 bp, Homo sapiens
  misc_feature: GZ8MTXP01AUQWL.19.10.A10.1.454.CMB.2.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagtactctcgtgcacgaccggtgctcgatttagcgtcgatctcaggggggggagaggagtcccagccttggggttcccgagtgttttcgttcagtgatcaggactgaacacgtaggactcaccatggagtttggcctgagttggattttcctttctgtcttatttttaaaaggtgtcctgtgtgaggtgcgcctggtggagtcgtgggggaggcgtggtccaggcccgggggtcctgagactctcctgtagaagttatggattcaattcgctagcggctggctgtgctgggtcnccaggctccgagggagggctggagtggtggccnatcaaagaggagatataggaaggggagcgaanagactacgctgcacccgtgaagngcagtattaccatgacaagagatgaattacaaactaaaagtacagttagtaatcgtagaactaaatagaaacgaacggacgtagaacgaaccgaacggaacaacgacacctaattaacttattactaataaataagaagtaacggttaaggggaaagggggaaaagggttaacgggacggacggaaccgtacgtcgtacgtcgttcgtcaacgtaacccg

SEQ ID NO: 316673 - DNA, 572 bp, Homo sapiens
  misc_feature: GZ8MTXP01D6L83.19.10.A10.1.454.CMB.2.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (536)..(536): a, c, t, g, unknown or other
  misc_feature (536)..(536): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtcttgacccctggggaaagacgcccaccctctcctgcgagggccgataagagtgttgacagctaccttcttgcctggtaccagcagagaccgtggccaggcctcccgaggtctccgtcgtttatggtcgccgtccaccgacgggccacgtcggccactccccgataggttcaggtggctagtgtcgtcgtcgggactagtacttcacttcacncatcagcagacgtggactctagtatnttgctagtagttattagagtacaacgtattagtgtatagtcgtacctaccgtcggtggtagtacgtagttcgggaacgtaggggaacctaagggtaagtaagacgaaagttcgtggtgacgttnactaacgattgtcgttcttctaacttcccgttcccg

SEQ ID NO: 316674 - DNA, 676 bp, Homo sapiens
  misc_feature: GZ8MTXP01AGK9C.19.10.A10.1.454.CMB.2.raw
  modified_base (326)..(326): a, c, t, g, unknown or other
  misc_feature (326)..(326): n is a, c, g, or t
  modified_base (412)..(412): a, c, t, g, unknown or other
  misc_feature (412)..(412): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccgaggcccgggggtcctgagactctcctgtagaagttatggattcaacttcgctagcggctggctgtgctggtcgccaggctcgagggagggctggaggtgggtgccgnatcgaagaggagatagtaggaagggggaggcgagagactaccgctgccacccgtgaagaggcagtactttaccagtgtacaaaganatgattacaacaaagttcaagtcgtaatcgtagacctaaaagtcgaaacacgggtaccctaaggaaacggaacccggaaaggaccaacgacggtacccttaaagttttaacctaagtttaacggtaaactaaaagttaggttaaaacgtaaaccggggttaggggggtaaaaccggggggtaaaagttcggggggaacccttaacgggggaaccccgttgggttaacccgttcccgggtcgttccggttccgaacggtcccccg

SEQ ID NO: 316675 - DNA, 579 bp, Homo sapiens
  misc_feature: GZ8MTXP01EMPOC.19.10.A10.1.454.CMB.2.raw
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggagcgtggtccaggcccgggggtcctgagactctcctgtagtaagttatggattcaacttcgctagcggctggctgtgcgtggtcgcaggctcgagggagggctggagtggtgcgnatcaagaggagatagtggaaggggngcgagagactacgctgccacccgtgaagaggcagtatttaccatgtacaaganatgaattcaactaaagtctaagtntatctagacaaatgaacngggctaggaacgaccgagacacgagacctaattcaattagaacaaaagttgaaagtacgggttaggggggaaacgggggtaaattcgggggcccaaggggaaccctgggtccctacggtcttcggtcaacgtcccc

SEQ ID NO: 316676 - DNA, 585 bp, Homo sapiens
  misc_feature: GZ8MTXP01BHAIQ.19.10.A10.1.454.CMB.2.raw
  modified_base (268)..(268): a, c, t, g, unknown or other
  misc_feature (268)..(268): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (554)..(554): a, c, t, g, unknown or other
  misc_feature (554)..(554): n is a, c, g, or t
  modified_base (574)..(574): a, c, t, g, unknown or other
  misc_feature (574)..(574): n is a, c, g, or t
  modified_base (576)..(582): a, c, t, g, unknown or other
  misc_feature (576)..(582): n is a, c, g, or t
  modified_base (584)..(585): a, c, t, g, unknown or other
  misc_feature (584)..(585): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaaggggctggagtgggttggccgcatcaagaggagatatggaaggggaggcgacagactacgctgcacccgtgagaggcagtatttaccatgtacaagagatgattacaacaaagtcagtgtatctgacaaatgaaacngacctaggaaacgaccggaggaccacacgacctaatttactattagaacaaagtgaagtacggtaggggggaacgggggtaaagtcgggggacgaacggggtaccctggtcccctccggtctcgtccacgtcccaccgaacgacgggccctagtccggtcccttccccgnggccctccctgcctcgaggtcnccctaccggtgagcgcacgtggcccgccgtggggcttcgcgtcgtacaaccgtctaccgtacccaggagtcgtacgcgggaacgtccgggggancgggacgaacgggtcagagngnnnnnnngnn

SEQ ID NO: 316677 - DNA, 687 bp, Homo sapiens
  misc_feature: GZ8MTXP01BNCUB.19.10.A10.1.454.CMB.2.raw
  modified_base (292)..(292): a, c, t, g, unknown or other
  misc_feature (292)..(292): n is a, c, g, or t
  modified_base (408)..(408): a, c, t, g, unknown or other
  misc_feature (408)..(408): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccgggggtcctgagactctcctgtagaagttatggattcaacttcgctagcggctggctgtgctgggttcncaggctccgagggaggggctgggagtgggtgccgcatcaagagaaatagtaggaagggggagcgagagactacgcctgcacccgtgagaaggcaagtacttaccagtgtacaaganataggattacaactaaagtacaaggtacgtatccgtagacaaaagtcgaaacgagaccgtaggaaacggaccgaacgggtaacaaccgaacggtcctaaagttttacctaattagtaaaacctaaaagtggaaaattaccgggggtaaaggggggttaaacggggggtaaaaacgtttggggggaaacccccgttaacggggggttaaaccccgtgggggttaccctttaaccccggtcgtttacccggttacccgaaccggttccccgtaaccccggg

SEQ ID NO: 316678 - DNA, 539 bp, Homo sapiens
  misc_feature: GZ8MTXP01BOJNN.19.10.A10.1.454.CMB.2.raw
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (501)..(501): a, c, t, g, unknown or other
  misc_feature (501)..(501): n is a, c, g, or t
tcagtactctcgtgcacgaccggtgctcgatttagcgtcgatctcaggggggagctgctcagttaggacccagagggaaccatggaaaccccagcgcagcttctcttcctcctgctactctggctcccagatagcaccggataaattttcttgacgcagtctccaggcaccctgtctttgacccctggggaaanagcccacctctcctgcagggccataagagtgttgacagctacctttntttgctggtaccagcagagacctggccaggctccaggctctgttanggncgtcacgaggccagtgcactcccganaggtcagtggctagtgtgtcgtggacagacttcactctcaacatcagcatacgtgacgctagaagttatttgactagttagttaacttacgtcgtacaaacgtatattggatggacttcacgttcggtgtcgtaatacgttggaccgtagggaaccgaaggttaagaaagacaaacgacgttggngccttgacctaacagttctgtcttctaattcccgtccc

SEQ ID NO: 316679 - DNA, 666 bp, Homo sapiens
  misc_feature: GZ8MTXP01AMM5U.19.10.A10.1.454.CMB.2.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccgaggcccgggggtccctggagactctcctgtagaagttatggattcaacttcgctagcggctggctgtgcgtggtcncgagctcgagggagggctggngtggtgccgnagtcaagaggagatagtaggaagggggagacgagagactaccgctgccgacccgtgaagaggcaagtacgtttaccagtcgtacaagagatagtaacttacaaataaagtacagttagtaactcgtagaactaaagcgaaacacgggacccgtaaggaaaccgaccggaaacggaccaacgacgtaccttaattttaacctaattacgtaaacaaatggaaaggttaacggggaggggggtaaaacgggggttaaagttcgggggaacccttaacgggggaaccccgttgggttccccgtaccgggtccgttaccggtaacgaacccggtaacccccg

SEQ ID NO: 316680 - DNA, 704 bp, Homo sapiens
  misc_feature: GZ8MTXP01DVQMC.19.10.A10.1.454.CMB.2.raw
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
tcagtactctcgtgcacgaccggtgctcgatttagcgtcgatctcaggaggggagaggagtcccagccttggggttcccgagtgttttcgttcagtgatcaggactgaacacgtaggactcaccatggagtttggcctgagttggattttccttctgctattttaaaggtgtcctgtgtgaggtgcgcctggtggagtcgtggggaggcgtggtccgaggcccgggggtcctgagactctcctgtagaagttatggattcaacttcgctagcggctggctgtgctgggtcgcaggctccgagggaagggctggagtgggtgcgcatcaagaggagatagtggaaggggagcganagacctagctgccaccgtgagnggcagtactttaccatgtacaaagagtatagtacttaccgaaataaaaggtacaagggttnttaactcggttaaagaactaaagtaacgaaacggaacgtacgtaacgaaacggaaaccggaaacggaaccgaacgaaccgtaaccttaaactttaaacgtttaaacgttaaagttaaaacgtaaaagttaaaggttaaacggttaaacggggtaaacggggggtaaacggggggttaaaacgggggttaacgggggttaaccggggtaaccggggtaaccggttaaccgggttccggttaccggttaccgtccgttaaccgtaaccg

SEQ ID NO: 316681 - DNA, 735 bp, Homo sapiens
  misc_feature: GZ8MTXP01BW6K2.19.10.A10.1.454.CMB.2.raw
  modified_base (328)..(328): a, c, t, g, unknown or other
  misc_feature (328)..(328): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtcctgagactctcctgtagaagttatggattcaacttcgctagcggctggctgtgcgtgggttcgcaggctcgagggagggctggaggtggtgccgnatcgaagaggagagtagtagggaaagggggaggacgaacgacgactaccgcgtacgccgaaccccggtggaaaggacgggcagtaactttaacccgagttcgtacgaaaggagtattaggtaattaccgaaacgtaaaaggttactaaagggttagttaacttacgtagaacaaaagttagaaaccagggtacccgtaaggaaacgaacccgggaagaaccgacgaacgacctttaaagtttaaccttaagtttaactaaacgtaaagttaacgggttaaacggttaaacggggttaaggggggtaaaaccggggggtaaaagttcggggggaacccgttaaccgggggtaaccctttgggggtcccctttccgggtaccgttccgttaaccgaaccggtaaccccg

SEQ ID NO: 316682 - DNA, 619 bp, Homo sapiens
  misc_feature: GZ8MTXP01D363M.19.10.A10.1.454.CMB.2.raw
  modified_base (566)..(566): a, c, t, g, unknown or other
  misc_feature (566)..(566): n is a, c, g, or t
  modified_base (582)..(582): a, c, t, g, unknown or other
  misc_feature (582)..(582): n is a, c, g, or t
  modified_base (605)..(605): a, c, t, g, unknown or other
  misc_feature (605)..(605): n is a, c, g, or t
  modified_base (610)..(611): a, c, t, g, unknown or other
  misc_feature (610)..(611): n is a, c, g, or t
  modified_base (613)..(619): a, c, t, g, unknown or other
  misc_feature (613)..(619): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcaccgtgagagcagatttaccatgtacaagagatgattacaacaaagtacagtgtatctgacaaatagaacagcctagaacgaaccgagacacagacctaatttactattgtaacaaagtagaagtacggtagggggaaacgggggtaaagttgggggaccaaggggaccctggtccctccggtctcgtccacgacccctacccgaacgtacgggcccctaacgttccggtccccttcccccgtggcccgtccccgttgccctccggaggaccgcctacccgtccgaagacgccaacgtcggcccggcccgtgggggccttggacccgtggtacgaaacggtccttaccgttaccccgagaacgtacgttacgngggaacgcggggttcncggggacgaaacgggcgttaagngttgnngnnnnnnn

SEQ ID NO: 316683 - DNA, 599 bp, Homo sapiens
  misc_feature: GZ8MTXP01BFSA3.19.10.A10.1.454.CMB.2.raw
  modified_base (292)..(292): a, c, t, g, unknown or other
  misc_feature (292)..(292): n is a, c, g, or t
  modified_base (583)..(583): a, c, t, g, unknown or other
  misc_feature (583)..(583): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgctgggtcnccaggctccgagggagggctggagtgggttgccgcatcaagaggagatagtaggaaggggagcgacagactacgctgccacccgtgaagagcagactttaccatgtacaagagatgatacgaacaaagtcaagtgtaatctagacaaagtgaaacagccgtagaaacgacccggaagaccacgtacgaccctaatttaccaatttgaacaaaagttggaaagtaccggttaggggggaaacgggggtaaaattcgggggcccaaggggaaccccttgggtcctaccggtcnccggtcaacggtcccc

SEQ ID NO: 316684 - DNA, 625 bp, Homo sapiens
  misc_feature: GZ8MTXP01BFE07.19.10.A10.1.454.CMB.2.raw
  modified_base (331)..(331): a, c, t, g, unknown or other
  misc_feature (331)..(331): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (609)..(609): a, c, t, g, unknown or other
  misc_feature (609)..(609): n is a, c, g, or t
tcagtactctcgtgcacgaccggtgctcgatttagcgtcgatctcaggggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgccgtggtggagtcgtgggggaggcgtggtccgaggccccgggggtcctgagactctcctgtagaagttatggattcaacttcgctagcggctggctgtgcgtggtcgcgaggctcgagggagggctggagtggtgccgnagtcaagaggagatagtagggaagggggagacgacgaagaccgtaccgcctcgaccgacccggtgaaagagggcaagtactttacagtagtacgaaagagtatagtattaacgaataaagttacgaaggtnttanactagaacctaaagtagaaaccacgggtaccgtaaggaaaccggacgtagaaccacagtacctattactagtataacaaatgttaaacgtaggacgggggaaacggtaaggttcggggacaacggggtcctcggtcgtccggnttcgtcgccgtaaccc

SEQ ID NO: 316685 - DNA, 609 bp, Homo sapiens
  misc_feature: GZ8MTXP01ALE7E.19.10.A10.1.454.CMB.2.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (573)..(573): a, c, t, g, unknown or other
  misc_feature (573)..(573): n is a, c, g, or t
tcagtactctcgtgcacgaccggtgctcgatttagcgtcgatctcaggggggagctgctcagttaggacccagagggaaccatggaaaccccagcgcagcttctcttcctcctgctactctggctcccagatagcaccggagtaaatttttctgacgcagtctccaggcacctgtcttgaccctggggaaangccaccctntcctgcagggccataagagtgttgacagtctaccttcttgccttgggtaccagcagacgacctggccaggcctcccgaggctccgtcgtttancggtnccgtccaacgagggcccacgtggacactcccccggatacggttcaggtcggacaggtgtacgtcgtacgggacagtacttcgactctcgaacctagtccaggtacagtactggacgtcctagtaagtaagtttggactagtacgttattacgtgtactaaagtataagttggagttagacgtctaccgtccgtaggtcggtaacgttaagttcgggacgtacggggtaacctaaagggttaacgaaaggttaacgaaacggaacgtaggtcggngttcgactaacatcgtagtcttctaacttccgtccc

SEQ ID NO: 316686 - DNA, 671 bp, Homo sapiens
  misc_feature: GZ8MTXP01BPJMZ.19.10.A10.1.454.CMB.2.raw
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgctaattttaaaaggtgtcctgtgtgaggtgcgcctggtggagtcgtgggggaggcgtggtccgaggccccgggggtccctgacgactctcctgtaagaagttatggattcaacttcgctagcggctggctggtgcgtgggttcgccaggctccgagggaggggctggagtgggtggccgnatcaaggaggagatagtggaagggggngacgacgagactaccgctgccacccggtgaagacggcaagtacttaccatgacagagatgatcgaactaaagtacaagttgtatacgtagactaaaagtgaaaccgaggacccgtagaaaccgacggaacggaccacgaaacgtcccttaaagttttactaactttacggtaaactaaacgttagaaaacgttaacgggggttacgggggaaaacggggggtaaaacgtttccgggggaccgttaaccggggtaacccgttcgggttaaccttccccggttacgttaccgtccgaacgtcccccg

SEQ ID NO: 316687 - DNA, 719 bp, Homo sapiens
  misc_feature: GZ8MTXP01AN812.19.10.A10.1.454.CMB.2.raw
  modified_base (388)..(388): a, c, t, g, unknown or other
  misc_feature (388)..(388): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgtctattttaaaaggtgtcctgtgtgaggtgcgccgtggtggagtcgtggggaggcggtcggtccgaggcccgggggtcctgacgactctcctgtagaagttatgtattcaacttcgctagcggctggctgtgtcgtggttcgccgaggctccgagggtaagggctgggagtggtgccgcatcgaaagaggagatagtggaaggggagcgacgagactacgctgcgacccgngaagacgcagtactttaccagtagtacaaagagtatagtaacttaccgaaagtaaagtacgttaaggtacttaactacgtacgaactaaaacgtacgaaccgtaacggggtaacccgttaaggaaaaccggaacccgaaccgggaaacgacctaaacgggttacccttaaattttaaccgtaaagttaaccgtaaagtaaataggttaaacgttacgggggttacggggtaaacgggtaacgggttaaaacgggttccggggaacccggtaacgggttaacccccgtggggttcccctaccgggttacgtccccgttaaccggtaaccccg

SEQ ID NO: 316688 - DNA, 543 bp, Homo sapiens
  misc_feature: GZ8MTXP01B07QT.19.10.A10.1.454.CMB.2.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
  modified_base (505)..(505): a, c, t, g, unknown or other
  misc_feature (505)..(505): n is a, c, g, or t
tcagtactctcgtgcacgaccggtgctcgatttagcgtcgatctcaggggggagctgctcagttaggacccagagggaaccatggaaaccccagcgcagcttctcttcctcctgctactctggctcccagatagcaccggagaaattttctgacgcagtctccaggcaccctgtcttgacccctggggaaangccaccctctcctgcagggccaataagagtgttgacagctacctttnttgcctggtaaccagcagagacctggccaggctcccaggctctgttanggtncgtccacgaggccatggcacgtccccganaggttcagtggcagtgngtctgggacagacttcactctcaacgatcaagtcaagactggganctgaagtatttcgatagttagtattactgtacaaacgatatgaattgagtcacctcgtgtcggactagttcggccgaaggggaccaaaggttaagaaacgttagaaaaccgagttaggtcggnttcgacaacctatcttcgtcttactaacttcctccccg

SEQ ID NO: 316689 - DNA, 704 bp, Homo sapiens
  misc_feature: GZ8MTXP01C22AS.19.10.A10.1.454.CMB.2.raw
  modified_base (442)..(442): a, c, t, g, unknown or other
  misc_feature (442)..(442): n is a, c, g, or t
tcagtactctcgtgcacgaccggtgctcgatttagcgtcgatctcaggggggggagaggagtcccagccttggggttcccgagtgttttcgttcagtgatcaggactgaacacgtaggactcaccatggagttggcctgagttggattttcctttctgctattttaaaaggtgtctgtgtgaggtgcgcctggtggagtcgtggggaggcgtggtccgaggccccggggggtcctgagactctcctgtagaagttatgattcaacttcgctagcgctggctgtgcgtcggtcgcaggctcggagggagggctggagtggtgcgcatacaagaggagagtagtaggaacgggggagcgaacgagactaccgctagccacccggtgaaagaggcagtaactttaccgatggacaaagagtatagtaacttcgaaataaaacgtntagttagtaatcgaacgaactaaagtacgaaacgtacggaactaaggaaaacggaccggaaagaaccaacgtacgtaacctttaaacgtttaacttaaagttacgtaaaaacgtaaagtaaggttaaacgggttaaacgggggttaaacggggggggtaaaacgggggtaaagttacccggggggaaccgttaaacccgggggttaacccgttcgggttccccgtacccggttccgttaccgtaacccggaacccgtccccg

SEQ ID NO: 316690 - DNA, 520 bp, Homo sapiens
  misc_feature: GZ8MTXP02HS4ZB.19.10.A10.1.454.CMB.2.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (513)..(520): a, c, t, g, unknown or other
  misc_feature (513)..(520): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcaacaaagtacagtgtatctgcaaatgaacagcctgaagaccgaggacacagccatttactatgtacaaatgaatactggggacgggggaaaattggggaccaggggaaccctggtcctccgtctcgtcagcctcaccaagggcccatcggtctccccctgccgccctgctccaggacncaccncgagacgcacagccggccgtgggctgccgtggacaaggacctactcccgacgagacgtacgngacggcgggtcncggacgaacggccgactaanagngnnnnnnnn

SEQ ID NO: 316691 - DNA, 518 bp, Homo sapiens
  misc_feature: GZ8MTXP02JWRMB.19.10.A10.1.454.CMB.2.raw
  modified_base (193)..(193): a, c, t, g, unknown or other
  misc_feature (193)..(193): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagcaccttcttgcctggtaccagcagagacctggccaggctcccaggctcctcgttatggtgcgtccaccagggccactggcatccccganaggttcagtggcagtgtgtctgggacagacttcactctcnccatcagcagactggacgcctgaatatttgcagtgtattactgtacacgatatgatgagtcacctcgtggtgactagttggcagggggaccaagggttagaagtacaaaacgtacgtaggtcggactgacaaccgatcgtgtcttcactccttccccg

SEQ ID NO: 316692 - DNA, 531 bp, Homo sapiens
  misc_feature: GZ8MTXP02FYWA7.19.10.A10.1.454.CMB.2.raw
  modified_base (417)..(417): a, c, t, g, unknown or other
  misc_feature (417)..(417): n is a, c, g, or t
  modified_base (524)..(531): a, c, t, g, unknown or other
  misc_feature (524)..(531): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatacgtggggacggggaaaattggggaccagggaaccctggtcctccgtctcgtcagcctcaccgaagggcccatccggtccttccccctggccgccctgccctccgagggacnccacccgtcccgagacgcacgagccggcccctggggcctgccctgggtcaacggtctacttccccgagagagtactggacgcgggctggccaaggccgacagtaggnnnnnnnn

SEQ ID NO: 316693 - DNA, 512 bp, Homo sapiens
  misc_feature: GZ8MTXP02I23G0.19.10.A10.1.454.CMB.2.raw
  modified_base (437)..(437): a, c, t, g, unknown or other
  misc_feature (437)..(437): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (506)..(512): a, c, t, g, unknown or other
  misc_feature (506)..(512): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactatgtaacaaatgaatacgtggggacgggggaaaattggggaccaggggaaccctggtcctccgtctcgtcagccctccaccaagggcccatccggtccttccccctgggccgccctgccctcccaggacgcacctccgagacgcacngccggccctgggctgcctggtcaaggctacgtccagngagtacngacgcggctggcaaggcncataggnnnnnnn

SEQ ID NO: 316694 - DNA, 546 bp, Homo sapiens
  misc_feature: GZ8MTXP02IV7AA.19.10.A10.1.454.CMB.2.raw
  modified_base (505)..(505): a, c, t, g, unknown or other
  misc_feature (505)..(505): n is a, c, g, or t
  modified_base (537)..(537): a, c, t, g, unknown or other
  misc_feature (537)..(537): n is a, c, g, or t
  modified_base (539)..(546): a, c, t, g, unknown or other
  misc_feature (539)..(546): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctgaagaccgaggacacagccatttactattgtaacaaaatgaaatacgtaggggaacgggggaaaattggggaccaggggaaccctggtcctccgtctcgtcagccctccaccaagggccccagtccggtccttcccccgtggccgccctgctcccgaggacgccacctccgagacgcacagccggcccctgggcctgccctggtaccaaacggcctaacttcccgaagagagtacgngacggcgggctcggacgaacggcgacagtagngnnnnnnnn

SEQ ID NO: 316695 - DNA, 560 bp, Homo sapiens
  misc_feature: GZ8MTXP02HD75I.19.10.A10.1.454.CMB.2.raw
  modified_base (410)..(410): a, c, t, g, unknown or other
  misc_feature (410)..(410): n is a, c, g, or t
  modified_base (551)..(551): a, c, t, g, unknown or other
  misc_feature (551)..(551): n is a, c, g, or t
  modified_base (553)..(560): a, c, t, g, unknown or other
  misc_feature (553)..(560): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccacatcaagaggagatatgaaggggaggcgacagactacgctgcacccgtgagaggcagatttaccatgtcaagagatgattcaacaaagtacagtgtatctgcaaatgaaacagcctgaaagaccgaggacacagccatttactattgtaacaaatgaatacgtaggggaacggggaaaattggggaccagggaaccctggtcctccgtctcgtcagccctcaccgaagggcccagtccggtccttcccccgtgggcccnccctgcctccgagggacgcccaccctcccgagacgccacgacgccgggccctggggcctgccctgggtaccaaaggacctaccttccccaagagacgtacgtggacgccggggctcgggacgaaacgggccgacagtaggngnnnnnnnn

SEQ ID NO: 316696 - DNA, 583 bp, Homo sapiens
  misc_feature: GZ8MTXP02HEYDM.19.10.A10.1.454.CMB.2.raw
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (578)..(579): a, c, t, g, unknown or other
  misc_feature (578)..(579): n is a, c, g, or t
  modified_base (581)..(583): a, c, t, g, unknown or other
  misc_feature (581)..(583): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatacgtggggacgggggaaaattggggaccagggaaccctggtccctccgtctcgtcagccctccaccgaagggcccagtccggtccttccccccgtgggcccgccctgccctccaggacgccaccctcccgagacgccacgagccggccctggggcctcgcccgtgggtaccaaacgggtaccctaccgttccccgaacggacggtacgtaaccgtcgggaacggccgggggcttacggggaccgaaacgggccggacaagtacggngncgcnncnnn

SEQ ID NO: 316697 - DNA, 533 bp, Homo sapiens
  misc_feature: GZ8MTXP02J1WB7.19.10.A10.1.454.CMB.2.raw
  modified_base (490)..(490): a, c, t, g, unknown or other
  misc_feature (490)..(490): n is a, c, g, or t
  modified_base (524)..(524): a, c, t, g, unknown or other
  misc_feature (524)..(524): n is a, c, g, or t
  modified_base (526)..(533): a, c, t, g, unknown or other
  misc_feature (526)..(533): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtaacaaatgaatacgtaggggacgggggaaaattggggccaaggggaacccctggtccctccgtctcgtcagcctcaccaagggcccatcgtcttccccctggccgccctgctccgaggacgcacccgtccgagacgcacagccggtccctggggctgccctgggtacaaggccttactccccagagagtaccgngacggcgggctcggacaagggccgacgtagtagngnnnnnnnn

SEQ ID NO: 316698 - DNA, 608 bp, Homo sapiens
  misc_feature: GZ8MTXP02FV0QD.19.10.A10.1.454.CMB.2.raw
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (601)..(602): a, c, t, g, unknown or other
  misc_feature (601)..(602): n is a, c, g, or t
  modified_base (606)..(607): a, c, t, g, unknown or other
  misc_feature (606)..(607): n is a, c, g, or t
tcagtactctcgtgcacgaccggtgctcgatttagcgtcgatctcagggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcacaaagtacagtgtatctgcaaaatgaacagcctgaagaccgaggacacagccatttactattgtacaaatgaatacgtggggacggggaaaattggggccaggggaaccctggtcctccgtctcgtcagccctccnccaagggcccatccggtccttccccctggcccnccctncctcaggcnccacctcgagacgcacgacggccggcccgtggggcctcggcccgttaggggtaccaaaacggggtaccctttaacccgttacccccgaaacgggaacggtaacgggttaaccgtggggaacgggtcccgggggaccttacggggtaccggaaacgggaccggaccgaacgtaacggaacgacgcgcnncgcnng

SEQ ID NO: 316699 - DNA, 509 bp, Homo sapiens
  misc_feature: GZ8MTXP02FZ2N9.19.10.A10.1.454.CMB.2.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagcaccttcttgcctggtaccagcagagacctggccaggctcccaggctcctcgttatggtgccgtccaccagggccactggcatccccganaggttcagtggcagtgtgtctgggacagacttcactctcacatcagcagactggacnctagaagtatttgcagtgtattactgtacaagatatgatgagtcactcgtgtgactagttggccgtaggggactaaggtagaagtacaaacgaactgtcgctgcaacgtatctagtcttcactctcccg

SEQ ID NO: 316700 - DNA, 608 bp, Homo sapiens
  misc_feature: GZ8MTXP02HWUYL.19.10.A10.1.454.CMB.2.raw
  modified_base (448)..(448): a, c, t, g, unknown or other
  misc_feature (448)..(448): n is a, c, g, or t
  modified_base (574)..(574): a, c, t, g, unknown or other
  misc_feature (574)..(574): n is a, c, g, or t
  modified_base (599)..(599): a, c, t, g, unknown or other
  misc_feature (599)..(599): n is a, c, g, or t
  modified_base (601)..(608): a, c, t, g, unknown or other
  misc_feature (601)..(608): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatggaaggggaggcgacagactacgctgcacccgtgagagtcagtatttaccatgtacaagagatgattcaacaaagtacagtgtatctagacaaatgaaacagcctaggaacgaccgaggacacacgcctaatttactattagtaaacaaaagtgaaagttacgggtaggggggaaacgggggtaaaagttcggggaccgtaacggggtaccctggtcccctccgtcctcgtacacgtcccctacaccggaacgggccctacgtcccggttcccttcccccgnggcccgccctgcccgtacgacgggcaccctacccgtccggagacgccacgtacggccggtccccgtggccttcgcccgttagggtaccaaacggtccttacccgttcccgaaggagtacgtacggnggacggcggcgcgacgagtcgacangnnnnnnnn

SEQ ID NO: 316701 - DNA, 575 bp, Homo sapiens
  misc_feature: GZ8MTXP02JJN7B.19.10.A10.1.454.CMB.2.raw
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (517)..(517): a, c, t, g, unknown or other
  misc_feature (517)..(517): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(575): a, c, t, g, unknown or other
  misc_feature (570)..(575): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtcaaagtgtatctgcaaatgaacagcctagaagaccgaggacacagccatttactattgtaacaaatgaatacgtaggggacgggggaaaattggggaccagggaaccctggtccctccgtctcgtcagcctccaccgaagggcccatccggtccttcccccgnggcccgccctgcctccaggcnccacctccgancgccacgagccggccctggggcctcgcccgtggggtacaaacggggtaccctaacgttcccccgaaggtacggtaacgtaccngggaacggccgggggtcctaggggacaaacggggccgaccaagtacggngncnnnnnn

SEQ ID NO: 316702 - DNA, 603 bp, Homo sapiens
  misc_feature: GZ8MTXP02JSR88.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctggtcgccaggctccgagggaggggctggagtgggttggccgcagtcaaggaggagatagtggaaggggagcgacagactacgctgcaccgtgagaggcagatttaccatgtacaaagagatgattacaacaaagtacagtgtatctagacaaatagaacagcctagaaacgaccggaggaacacgacgcctatttactattagtaacaaagtagaaagtaacggtagggggaaacggggggtaaaagttcgggggaaccgtaacgggggaacccgtcggggttaccgttacccggtcgtccggtaccgacgtccccg

SEQ ID NO: 316703 - DNA, 536 bp, Homo sapiens
  misc_feature: GZ8MTXP02JGDR4.19.10.A10.1.454.CMB.2.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgtgacagcaccttcttgcctggtaccagcagagacctggccaggctcccaggctcctcgttanggtncgtccacgaggccactggcactccccganaggttcagtggcagtgtgtctggggacagacttcactctcaccatcagcagactganctgaagtatttgntagtgtattactgtacaagatatgatgagtcaccgtcgtgtggactagttggccgaggggactaaggttaggaaacgtacgaaacggtaaactggtacgacgtaggaccaacgtactacgtcgtccttactacttccgtttaccccg

SEQ ID NO: 316704 - DNA, 568 bp, Homo sapiens
  misc_feature: GZ8MTXP02HKQ0S.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctggttcgccaggctccgagggaaggggctgggaggtgggttggccgcatcaagaggagatagtggaaggggaggcgacagactaccgctgcaccgtgagagcagattaccatgtacaagagatgattcaacaaagtacagttgtatctagacaaatgaactagcctaggaagacccgagacacagcctaattactattagaactaaaatgaaatacggtagggggaaacgggggaaaagttcggggacgagggtaaccgtggtctccgtctcgtcacgtaccc

SEQ ID NO: 316705 - DNA, 571 bp, Homo sapiens
  misc_feature: GZ8MTXP02GXLUD.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccgggggtcctgagactctcctgtagaagttatggattcaacttcgctagcggctggctgtgctgggttcgccaggctccagggaaggggctggagtgggttggccgcatcaagaggagatatggaaggggagcgacagactaccgctgcacccgtgagaggcagatttaccatgtcaaagagatgaattcaacaaaagtacagtgtaatctgacaaaatgaaacagcctagaagaccgaggacacagaccattacattgaacaaaatgaaatacgagggggaaacgggggaaaagttcgggggacctaaggggaaacccgtggtacctccgtctcgtacacggtacccc

SEQ ID NO: 316706 - DNA, 576 bp, Homo sapiens
  misc_feature: GZ8MTXP02H57IG.19.10.A10.1.454.CMB.2.raw
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(576): a, c, t, g, unknown or other
  misc_feature (571)..(576): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaaacagcctagaagaccgagacacagccatttactatgaacaaaatgaaatacgtgggggaaacgggggaaaatggggaccaaggggaaccctggtaccctccgtctcgtcagccctcaccgaacgggcccagtccggtccttcccccgtggcccgccctgcctaccgagggacgccaccgtccgagacgccacgaggcccggcctggggcctgccctgggtacaaagggtcctaccgttccccgaaggacgtacgtaccgtggacggccggggtctacgggaccgaaacggggcacctaagtaggngncnnnnnn

SEQ ID NO: 316707 - DNA, 595 bp, Homo sapiens
  misc_feature: GZ8MTXP02GAZ29.19.10.A10.1.454.CMB.2.raw
  modified_base (430)..(430): a, c, t, g, unknown or other
  misc_feature (430)..(430): n is a, c, g, or t
  modified_base (586)..(586): a, c, t, g, unknown or other
  misc_feature (586)..(586): n is a, c, g, or t
  modified_base (588)..(595): a, c, t, g, unknown or other
  misc_feature (588)..(595): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgcaaatgaacagcctgaagaccgaggacacagccatttactattgtacaaatgaatacgtagggggaacgggggaaaattggggaccagggaaccctggtccctccgtctcgtcacgccctccaccgaagggccccagtccggtccttcccccgtggcccgccctgccctccgaggcnccacccgccgagacgcacgacgtccggccccgtggggcctcggccccgttgggtacccgaaaacggggtaccctttaacccgttccccgaaacggacggtaacgttaccgtggaacgggccgggggcctcggggaccgaaagggccgacaagtagngnnnnnnnn

SEQ ID NO: 316708 - DNA, 584 bp, Homo sapiens
  misc_feature: GZ8MTXP02FXWT8.19.10.A10.1.454.CMB.2.raw
  modified_base (362)..(362): a, c, t, g, unknown or other
  misc_feature (362)..(362): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgagggaaggggctggagtggggttggccgcatcaagaggagatagtggaaggggaggcganagactacgctgcacccgtgagaggcagatttaccatgtacaaagagatgaattcaacaaagtacagtgtaatctgacaaatgaaacagcctagaacgaccgagacacagacctaatttactattgtaacaaaatagaaatacggtagggggaaacgggggaaaaagttcgggggccgaaaggggaaccccgtgggtacctccggtctcggtacacggccccg

SEQ ID NO: 316709 - DNA, 567 bp, Homo sapiens
  misc_feature: GZ8MTXP02HR9XE.19.10.A10.1.454.CMB.2.raw
  modified_base (287)..(287): a, c, t, g, unknown or other
  misc_feature (287)..(287): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagcaccttcttgcctggtaccagcagagacctggccaggctcccaggctcctcgttanggtgcgtccaccgagggccatggcactccccganaggttcaggtggcagtgtgtctgggacagtacttcactctcnccatcagcagactggacnctagagtatttgctagtagtattactgtacaacgtatatagtatagtagtcaccgtccgtggtaggacgtagtttcgggaccgtaggggtaccgtaaagggttaggaaacgtacgaaaacggtaacgtaggtacggcgtacggacctaaccgtatacgttcgttctttactactttaccttccccg

SEQ ID NO: 316710 - DNA, 516 bp, Homo sapiens
  misc_feature: GZ8MTXP02GEHAR.19.10.A10.1.454.CMB.2.raw
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagcaccttcttgcctggtaccagcagagacctggccaggctcccaggctcctcgttanggtgcgtccacaggccatggcatccccganaggttcagtggcagtgtgtcngggacagacttcactctcaccatcaagcagactggagctgaagtatttgctagtgtattacgtgtacaacgatatgatgagtcactcgtggtgactagttggcgagggacgaaggttcgaaagtacgaaacgaacgtgtacgactgacaacgtactctcgtctacactccgttacccg

SEQ ID NO: 316711 - DNA, 501 bp, Homo sapiens
  misc_feature: GZ8MTXP02G771Z.19.10.A10.1.454.CMB.2.raw
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggctcccaggctcctcgttatggtgcgtccaccagggccactgacatccccganaggttcagtggcagtgtgtctgggacagacttcactctcnccatcagcagactggganctgaagatttgcagtgtattactgtcaacgatatgatgagtcacctcgtgtggacatttggcaggggacaaggttgaagtcaaacgaactgtagctgcaaccgatctgtcttcactctcccg

SEQ ID NO: 316712 - DNA, 605 bp, Homo sapiens
  misc_feature: GZ8MTXP02G7JMM.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgagggagggctggagtgggtgccgcagtcaagaggagatagtaggaaggggaggacgacgaggactaccgctgccaccgtgagaggcagatttaccatgtacaaagagatgaattcaaacgtaaagtacagttgtaatcgtagacaaatggaaacagacctagaaacgaccggaaggaccaacgacacctatttactagttactaaacaaaatgaaatacggtagggggaaacgggggtaaaattcgggggaccgaaaggggtaacccgtgggtaccctccggtacttcggacacgtccccg

SEQ ID NO: 316713 - DNA, 607 bp, Homo sapiens
  misc_feature: GZ8MTXP02IFDWX.19.10.A10.1.454.CMB.2.raw
  modified_base (423)..(423): a, c, t, g, unknown or other
  misc_feature (423)..(423): n is a, c, g, or t
  modified_base (598)..(598): a, c, t, g, unknown or other
  misc_feature (598)..(598): n is a, c, g, or t
  modified_base (603)..(607): a, c, t, g, unknown or other
  misc_feature (603)..(607): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaaagaccgaggacacagccatttactattgtaacaaaatgaaaatacgtagggggaaacgggggaaaattggggaccaggggaaccctggtccctccgtctcgtcacgccctccaccgaacgggcccagtccggtcccttcccccgtggcccnccctgcctcccgaggacgcccacccgtccgagacgccacaggcccgggcccctgggggcctcggcccgtgggtacccgaaacgggacccttaccgttcccccgaacggtaagacggttaaccgtgggaacggccgggggcgtcggggaccaaacgggggccgaccaagtacgcgngcgcnnnnn

SEQ ID NO: 316714 - DNA, 507 bp, Homo sapiens
  misc_feature: GZ8MTXP02IJE7M.19.10.A10.1.454.CMB.2.raw
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccataagagtgttgacagcaccttcttgcctggtaccagcagagacctggccaggctcccaggctcctcgttatggtgccgtccaccgagggccactggccactccccganaggttcagtggcagtgtgtctgggacngtacttcactctcaccatcagcagactgggacgctgaagtatttgctagtgtattactgtacaacgatatgatgagtcactcgtgtgatgttggcgagggactaggtacagtacaaagactgtgactgacaacgatctacgtctctactctcccg

SEQ ID NO: 316715 - DNA, 562 bp, Homo sapiens
  misc_feature: GZ8MTXP02G3MZ2.19.10.A10.1.454.CMB.2.raw
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
tcagtactctcgtgcacgaccggtgctcgatttagcgtcgatctcagggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcgccaggctccagggaggggctggagtgggtgccgcatcaagnggagatagtggaaaggggaggcgaacgagactacccggctgaccaccggtgagaggcagatttaccatgtacaagngatgattcaacaaagtcagtgatctgacaaagtnaaacagcctagaagaccgagacacagccatttacatgaaacaaatgaaatacgtagggggaacgggggtaaaatcgggggacaaggggaaccctggtccgtccgtctacgtcacgtccc

SEQ ID NO: 316716 - DNA, 547 bp, Homo sapiens
  misc_feature: GZ8MTXP02J3NM1.19.10.A10.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
  modified_base (527)..(527): a, c, t, g, unknown or other
  misc_feature (527)..(527): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagctaccttcttgcctggtaccagcagagacctggccaggcctcccaggcctcctcgtttanggtgccgtccaccagggcccactggccatccccganggtttcagtggcagtgtgtctgggacngcttcactctcnccatcaggcagctgggacnctagaattntttagctagttagttatttacgtagttaccaaagtntatagatgacgtccaccgttcggtgggtagacttgttcgggaccgaacgggggaactaaagggtttgaattaccaaacgtactggtcgctcgcaacnctctctctctctccttcccg

SEQ ID NO: 316717 - DNA, 631 bp, Homo sapiens
  misc_feature: GZ8MTXP02FP5QG.19.10.A10.1.454.CMB.2.raw
  modified_base (363)..(363): a, c, t, g, unknown or other
  misc_feature (363)..(363): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggaaggggctggagtgggttggccgcatcaaagaggagatatggaaggggagcganagactacgctgcacccgtgagaggcagatttaccatgtacaagagatgattcaacaaaagtacagtgtaatctagacaaaatgaaacagacctagaaacgaccgaaggacacgacgacctaatttaactatttagtaactaaaagtagaaaattaacggtaggggggaaaacggggggtaaaaagtttacggggggacctaaacgggggtaaacccgttcggggttaaccgttccccgggtacgttcccggtacgaacggtacccccg

SEQ ID NO: 316718 - DNA, 583 bp, Homo sapiens
  misc_feature: GZ8MTXP02G3DQS.19.10.A10.1.454.CMB.2.raw
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgagggagggctggagtgggtgccgnatcaagaggagatagtggaaggggnggacganagactacgctgcaccgtgagagcagatttaccatgtacaagagtatgattacaaactaaagtacagttgtatctagacaaatgaaacagcctagaacgaccggagacacgagctaattactaattgaaaactaaatacgaaagttacggtagggggaaacggggtaaagtcgggggaccaaggggtaaccctgggtacccgtcgtacgtcgacgacgtacccc

SEQ ID NO: 316719 - DNA, 529 bp, Homo sapiens
  misc_feature: GZ8MTXP02H4565.19.10.A10.1.454.CMB.2.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagngccaccctctcctgcagggccgataagagtgttgacagcaccttnttgcctggtaccagcagagcctggctaggctcccgaggcctcctcgttanggtcgcgtcccacgagggccacgtggcatccccgataggttcagtggcagtgtgctgggacagtacttcactcncaccntcagcagacgtgacncctagagtatttgctagtgttattactgtactacgatatagatgtagtcaccgtcgtgtagactgttcggacgtagggacgaaggttgaaagtacgaaacgacgtgtacgactggacaacgatcgtcgtctttacacttcctcccg

SEQ ID NO: 316720 - DNA, 589 bp, Homo sapiens
  misc_feature: GZ8MTXP02GY7SG.19.10.A10.1.454.CMB.2.raw
  modified_base (412)..(412): a, c, t, g, unknown or other
  misc_feature (412)..(412): n is a, c, g, or t
  modified_base (540)..(540): a, c, t, g, unknown or other
  misc_feature (540)..(540): n is a, c, g, or t
  modified_base (580)..(580): a, c, t, g, unknown or other
  misc_feature (580)..(580): n is a, c, g, or t
  modified_base (582)..(589): a, c, t, g, unknown or other
  misc_feature (582)..(589): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctgaagaccgaggacacagccatttactattgtaacaaaatgaatacgtagggggaacgggggaaaattggggaccaggggaacccctggtccctccgtctcgtcagccctccaccgaacgggcccagtccggtccttccccccgnggcccgtccctcgcctccgaggcgcccacccgtccgagacgaccacgacggcccggtcccgtggggcctcggcccgttagggtaccaaacgggtaccttacccgttacccgaacggacgtacgtacgnggacggcgggacgtcgggacgaacgggccgacgtagtagngnnnnnnnn

SEQ ID NO: 316721 - DNA, 541 bp, Homo sapiens
  misc_feature: GZ8MTXP02G68UG.19.10.A10.1.454.CMB.2.raw
  modified_base (193)..(193): a, c, t, g, unknown or other
  misc_feature (193)..(193): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagcaccttctttgcctggtaccagcagagacctggccaggctcccaggctcctcgttanggtncgtccaccgagggccactggcatccccganggttcagtggcagtgtgtctgggacagacttcactctcaccatcagcagactggagcctgaagtatttgctagtgtattactgtacaacgatatgatgagtcaccgtcgtggtggactagtttcggccgtagggggacctaagggttacgaaacgttacaaaacggtactaggtcggactggacaaccgtattccgtagtccttctacttccttccccg

SEQ ID NO: 316722 - DNA, 538 bp, Homo sapiens
  misc_feature: GZ8MTXP02GMJZL.19.10.A10.1.454.CMB.2.raw
  modified_base (191)..(191): a, c, t, g, unknown or other
  misc_feature (191)..(191): n is a, c, g, or t
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagtactctcgtgcacgaccggtgctcgatttagcgtcgatctcaggggagctgctcagttaggacccagagggaaccatgggaaaccccagcgcagcttctcttcctcctgctactctggctcccagatagcaccggagaaattttcttgacgcagtctccaggcaccctgtcttgaccctggggaaangccaccctctcctgcagggccgataagagtgttgacagctaccttcttgcctggtaccagcagagacctggccaggctcccaggctcctgttanggtgcgtccacgagggccactggcatccccganaggttcagtgcagtgngtcngggacagcttcactcncaccatcagcagactgganctgaagtntttgactagtagtattactagtacaacgatagtgatgagtcaccgtcgtaggtgactagttcggccgtaggggaccgtaagggttagaaacggttacgaaaacggtaacgtggtacggactggaccaacgactactcgtcttacacttccttacccg

SEQ ID NO: 316723 - DNA, 560 bp, Homo sapiens
  misc_feature: GZ8MTXP02I34HJ.19.10.A10.1.454.CMB.2.raw
  modified_base (515)..(515): a, c, t, g, unknown or other
  misc_feature (515)..(515): n is a, c, g, or t
  modified_base (551)..(551): a, c, t, g, unknown or other
  misc_feature (551)..(551): n is a, c, g, or t
  modified_base (553)..(560): a, c, t, g, unknown or other
  misc_feature (553)..(560): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatggaaggggaggcgacagactacgctgcacccgtgagaggcagatttaccatgtcaagagatgattcaacaaagtcagtgtatctgcaaatgaacagcctagaagaccgaggacacagccatttactattgtaacaaatgaatacgtaggggaacgggggaaaattcggggaccaggggaaccctggtccctccgtctcgtcacgcctccaccgaagggcccatccggtccttcccccgtggcccgccctgcctccgaggacgcacctccgagacgcacacgccggtccctgggcctgcccgtgggtaccaacgggtaccttaccttccccgaacgtacggagttaccgnggacggcgggcgtcggacgaacgggcgacgagtagngnnnnnnnn

SEQ ID NO: 316724 - DNA, 572 bp, Homo sapiens
  misc_feature: GZ8MTXP02I25N3.19.10.A10.1.454.CMB.2.raw
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaagagccaccctctcctgcagggccataagagtgttgacagctaccttcttgcctggtaccagcagagacctggccaggcctcccaggctcctcgtttanggtgccgtccaccgagggccacgtggccactccccgataggttccaggtggcagtgtgtctgggacngacttcactctcaccntcagcagactgggacgcctagaagtatttgctagttgtattactgtacaacgtatagtgatgagtactaccgtcgtcggtgactagtttcggacgaggggaccgtaaggttacgaaacgttacgaaaacggtaacgtaggtacgggtactacggaccaaccgtaatcgttacgttctttacctactttaccgtttccccg

SEQ ID NO: 316725 - DNA, 600 bp, Homo sapiens
  misc_feature: GZ8MTXP02HVKXB.19.10.A10.1.454.CMB.2.raw
  modified_base (288)..(288): a, c, t, g, unknown or other
  misc_feature (288)..(288): n is a, c, g, or t
  modified_base (321)..(321): a, c, t, g, unknown or other
  misc_feature (321)..(321): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttctgacgcagtctccaggcaccctgtctttgacccctggggaaagagccaccctctcctgcagggccgataagagtgttgacagcaccttcttgcctggtaccagcagagacctggccaggctcccaggcctcctcgttanggtgcgtccacagggccactggcactccccganaggttcagtggcagtgtgtctgggacagacttcatctcaccatcagcagactggacgcctagaaagtatttcgctagtagttattactgttacaacgtatataggtaatggtaagtcaccgttccggtgggtacggaacctagtttcgggaccgtaacgggggaacccgtaaaagggttacggaaaaggtaaccgaaaaacggtaaaccgttggtacgggacgtacggaccaacccgtaataccttggtaccctttcctaactttacccctttcccccg

SEQ ID NO: 316726 - DNA, 506 bp, Homo sapiens
  misc_feature: GZ8MTXP02G8TPG.19.10.A10.1.454.CMB.2.raw
  modified_base (321)..(321): a, c, t, g, unknown or other
  misc_feature (321)..(321): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggctcccaggctcctcgttatggtgcgtccaccagggccactggcatccccganaggttcagtggcagtgtgtctggggacagacttcactctcaccatcagcagactgggagcctgaagtatttgcagtgtattactgtacaacgatatgatgagtcactcgtggtgactagttggccgaggggacaaggttgaagtacaaacgactgtcgctgcaacgatctcgtctcactctcccg

SEQ ID NO: 316727 - DNA, 566 bp, Homo sapiens
  misc_feature: GZ8MTXP02GQTZB.19.10.A10.1.454.CMB.2.raw
  modified_base (553)..(553): a, c, t, g, unknown or other
  misc_feature (553)..(553): n is a, c, g, or t
  modified_base (559)..(566): a, c, t, g, unknown or other
  misc_feature (559)..(566): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccattactatgtacaaatgaatacgtaggggacgggggaaaagttaggggccaggggaacccctggtccgtccgtctcgtcacgcctccaccgaaacgggcccaacttccggtccttccccccgtcgggcccgccccgttcgcccgtcccgacgggacgcccaccctcccggagacgccacgacgcggccccgtggggcctgcccgtgggtaccaacggaccttacttacccgacgagacgtactggagccggggctggaccaaggcgacntagggnnnnnnnn

SEQ ID NO: 316728 - DNA, 542 bp, Homo sapiens
  misc_feature: GZ8MTXP02HAFJ7.19.10.A10.1.454.CMB.2.raw
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (532)..(533): a, c, t, g, unknown or other
  misc_feature (532)..(533): n is a, c, g, or t
  modified_base (535)..(542): a, c, t, g, unknown or other
  misc_feature (535)..(542): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccacatcaagaggagatatgaaggggaggcgacagactacgctgcacccgtgagaggcagatttaccatgtcaagagatgattcaacaaagtacagtgtatctgacaaatgaaacagcctagaagaccgaggacacagccatttactattagaacaaaatgaaatacgtagggggaacggggaaaattggggaccagggaaccctggtccctccgtctcgtcagccctccaccgaacgggcccagtccggtcccttcccccgtggcccgccctgccctcaggcncacctccganacgcacgacgccggccctgggcctgccctgggtaccaaggacctacttcccagtacgagtaccgnggacgcgggncggacacggcacagnngnnnnnnnn

SEQ ID NO: 316729 - DNA, 516 bp, Homo sapiens
  misc_feature: GZ8MTXP02HEOOX.19.10.A10.1.454.CMB.2.raw
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcacttcttgcctggtaccagcagagacctggccaggctcccaggctcctcgttatggtnccgtccaccagggccactggcatccccganggttcagtggcagtgtgtctggggacagacttcactctcaccatcagcagactggagcctgaagtatttgctagtgtattactgtacaacgtatatgatggatcacgtcgngtgactgttggccgagggaccaaggttgaaacgtcaaacgtactgtcgacgtgacaaccgatcgtcgtctctacgtccttcccg

SEQ ID NO: 316730 - DNA, 582 bp, Homo sapiens
  misc_feature: GZ8MTXP02GHCTA.19.10.A10.1.454.CMB.2.raw
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggtcnccaggctccgagggagggctggagtgggtgccgcatcaagaggagatagtggaaggggagcganagactacgctgcaccgngagngcagattacatgtacaaagnaatgattacaacaaaagtacagtgtaatctagacaatagaacacgacgacgaagaaccggaacgaacgacgacgactacttaacttattagtaactaaactagaagtaacggtaagggggaaacgggggtaaaggttacggggacggacggaaccgtacggtcgtccgtcgtcgtcgacgacccg

SEQ ID NO: 316731 - DNA, 602 bp, Homo sapiens
  misc_feature: GZ8MTXP02GILEI.19.10.A10.1.454.CMB.2.raw
  modified_base (581)..(581): a, c, t, g, unknown or other
  misc_feature (581)..(581): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgaggggaaggggctggagtggggttgccgcatcaagaggagatatggaaggggagcgacagactacgctgcaccgtgacgagcagatttaccatgtacaagagatgattcaacgaaaagtacaagtgtaatctagacaaaatgaaacagacctagaaacgaacccgaaggaacacgacgcctaatttacaattgaaacaaaatgaaaattacgagggggaaacgggggaaaagttcgggggaccgaacgggggaacccgttcgggacttaccccggtntccggtaccacggtacccccg

SEQ ID NO: 316732 - DNA, 583 bp, Homo sapiens
  misc_feature: GZ8MTXP02JE54Z.19.10.A10.1.454.CMB.2.raw
  modified_base (291)..(291): a, c, t, g, unknown or other
  misc_feature (291)..(291): n is a, c, g, or t
tcagtactctcgtgcacgaccggtgctcgatttagcgtcgatctcaggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcnccaggctccagggaaggggctggagtgggttggccgcatcaagaggagatatggaaggggaggcgacagactaccgctgcaccgtgagaggcagatttaccatgtacaagagatgattcacaaagtacagtgtatctgacaaatgaaacaggcctgaaagaccggagacacagaccctaatttactattagtaacaaaatgaaataacgtagggggaaacgggggaaaagttcgggggaccgtaaggggaaccccgtggtaccgtaccggtctccggtaccacggtaccccg

SEQ ID NO: 316733 - DNA, 576 bp, Homo sapiens
  misc_feature: GZ8MTXP02HTU2U.19.10.A10.1.454.CMB.2.raw
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctgggttcgccaggctccgagggaagggctggagtgggtggccgnatcaagaggagatagtggaaggggnggcgacagactacgctgcaccgtgagagcagattaccatgcaaagagatagattacaacaaagtacagtgtatctgactaaatgaaacagcctagaacgacgagacacagacctatttactatagtaacaaaatagaaatacggtagggggaaacggggtaaagtacgggggaccgaagggaacccgttggtaccgtaccgtcgtccgtacgacgtacccc

SEQ ID NO: 316734 - DNA, 595 bp, Homo sapiens
  misc_feature: GZ8MTXP02JXSKV.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgagggaaggggctggagtgggttggccgcatcaagaggagatagtggaaggggaggcgacagactaccgctgcaccgtgagagcagatttaccatgtcaaagagatgattcaacaaagtacagtgtaatcgtagacaaaatgaaacagccgtagaaacgaccggaaggaacacgagaccctaatttactattagtaaactaaaatagaaagtaacggtagggggaaacgggggtaaaagttcgggggaccaaggggaacccgtgggtacctccggtcgtcgtcgaacgtccc

SEQ ID NO: 316735 - DNA, 615 bp, Homo sapiens
  misc_feature: GZ8MTXP02G77PK.19.10.A10.1.454.CMB.2.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (468)..(468): a, c, t, g, unknown or other
  misc_feature (468)..(468): n is a, c, g, or t
tcagtactctcgtgccacgaccggtgctcgatttagcgtcgatctcaggggcagagctctggagaagagctgctcagttaggacccagagggaaccatggaaaccccagcgcagcttctcttcctcctgctactctggctcccagatagcaccggagtaaattttctgacgcagtctccaggcaccctgtcttgaccccgtggggaaancgccaccctctcctgcgagggccgataagagtgttgacagctacttcttgcctggtaccagcagagacctggccaggcctcccgaggtccttcccgttcggtttancggtcgccgtcccaccgacgggcccacgtcggcccacgtcccccgacgtacggttccccgaggtcggacgtagttggtcgttcgtcggggactacgtaccttcgacctctaccacctaatcgacgcgaagcgtggggactcctaaggtaattntttgactaggtcttattactgtacaagtatatgatcgattccacgtcggtaggtacgtactggttacgggaccggtagggggtaacctaagggttacgaaaacgtaaccgaaaacggtacgttggacggtacctacggacctaaccg

SEQ ID NO: 316736 - DNA, 587 bp, Homo sapiens
  misc_feature: GZ8MTXP02IJMLP.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcgccaggctccgagggaaggggctgggagtgggttggccgcatcaagaggagatatggaaggggaggcgacagactaccgctgcacccgtgagaggcagactttaccgatgtacaaagagatgaattcaacaaaagtacagtgtaatctagacaaatgaaacagcctagaacgaccgaagacacagcctaatttactattagtaacaaaagtgaaagtacggtagggggaaacgggggtaaaattcgggggaccgaaggggaacccgtggtacctaccggtctacggtcacgtccc

SEQ ID NO: 316737 - DNA, 517 bp, Homo sapiens
  misc_feature: GZ8MTXP02GD654.19.10.A10.1.454.CMB.2.raw
  modified_base (193)..(193): a, c, t, g, unknown or other
  misc_feature (193)..(193): n is a, c, g, or t
  modified_base (324)..(324): a, c, t, g, unknown or other
  misc_feature (324)..(324): n is a, c, g, or t
  modified_base (412)..(412): a, c, t, g, unknown or other
  misc_feature (412)..(412): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctcctcgtttatggtgccgtccaccagggccactggcatccccganaggttcagtggcagtgtgtctgggacagacttcactctcaccatcagcagactggagctgaagtatttgctagtagtattactgttanaaacgatatgatgagtcacctccgtggtggacagtttggcgaaggggaccgaaggttagaagtacaaacgaaactgtgctgcaacatctcgtcttcactctcccg

SEQ ID NO: 316738 - DNA, 572 bp, Homo sapiens
  misc_feature: GZ8MTXP02H6JOP.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtcctgagactctcctgtagaagttatggattcaacttcgctagcggctggctgtgctgggttcgccaggctccgagggaggggctggagtgggtgcgcatcaagaggagatagtgaaggggaggcgacagactacgctgcacccgtgagaggcagtatttaccatgtacaaagagatgattcaacaaagtacagtgtatctgacaaatgaaacagacctgaaacgaccgaggaacacagccaatttacattgaaactaaatagaaatacggtagggggaaacgggggtaaaagtcgggggaccaggggaacccgtgggtcctaccggtctcgtcgacgtcccg

SEQ ID NO: 316739 - DNA, 587 bp, Homo sapiens
  misc_feature: GZ8MTXP02JHZ4O.19.10.A10.1.454.CMB.2.raw
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcncaggctccgagggagggctggagtgggtgcgnatcaagnggagatagtggaaggggagcgacagactaccgctgccaccgtgagaggcagacttaccatgtacaagagatgattcaacaaagtacagtgtaatctagacaaaatgaaacagcctagaaagaccgaggacacagcctaagtttaactattagaaactaaaagtgaaatacggtagggggaaacgggggtaaaattcgggggacctaaacggggaacccgtcggtaccgtcccggtacgtccgtacgacgtaccccg

SEQ ID NO: 316740 - DNA, 507 bp, Homo sapiens
  misc_feature: GZ8MTXP02IYW0G.19.10.A10.1.454.CMB.2.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (394)..(394): a, c, t, g, unknown or other
  misc_feature (394)..(394): n is a, c, g, or t
  modified_base (447)..(447): a, c, t, g, unknown or other
  misc_feature (447)..(447): n is a, c, g, or t
  modified_base (497)..(497): a, c, t, g, unknown or other
  misc_feature (497)..(497): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctccaggcaccctgtctttgacccctggggaaanagccacctctcctgcagggccataagagtgttgacagcaccttcttgcctggtaccagcagagacctggccaggctccaggctctcgtttanggtncgtccacgaggccacgtggcactccccganaggttccagtggcagtgtgtctggggacaggacttcacttctcaccatcagcagactggancctagaagtatttgctagtgtattactgtacaagatatgatgagtcacgtcgngtcgactagttcggacgagggaccaaggttgaaagtcgaaaacgactggngacgtgacac

SEQ ID NO: 316741 - DNA, 667 bp, Homo sapiens
  misc_feature: GZ8MTXP02HVJNH.19.10.A10.1.454.CMB.2.raw
  modified_base (289)..(289): a, c, t, g, unknown or other
  misc_feature (289)..(289): n is a, c, g, or t
  modified_base (380)..(380): a, c, t, g, unknown or other
  misc_feature (380)..(380): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggctcccgaggctcctcgttanggtgccgtccaccgagggccactggcacctccccgatacggttcaggtggcaggttggtgtcgtcggggacacgtacttcactctcacctntcagccagacgtggacgcctagaacgtatttcgactagttagttaactttacgtgtacctaaagtattaagttagaattacgggtacgttaccctaacccggttcccgggttaggggttacgggaacctttaggtttccgggacccggtaacgggggtaaacccgttaaaaggggtttaggaaaacggttaaccgaaaaacgtacggttaggtacgggcgttacggaccgtaacctacgttaccgtttacggttccttttaccgtacttttaccccgttacccccgg

SEQ ID NO: 316742 - DNA, 563 bp, Homo sapiens
  misc_feature: GZ8MTXP02GOJTY.19.10.A10.1.454.CMB.2.raw
  modified_base (553)..(554): a, c, t, g, unknown or other
  misc_feature (553)..(554): n is a, c, g, or t
  modified_base (556)..(563): a, c, t, g, unknown or other
  misc_feature (556)..(563): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatttcaagagatgattcacaaagtacagtgtatctgcaaatgaacagcctgaagaccgaggacacagccatttactattgtacaaatgaatacgtggggacggggaaaattggggaccaagggaaccctggtctccccgtctcgtcacgcctccaccacggggcccatccggtccttcccccgtggccgccctgcctcccgaggacgccaccctccgagacgccacacgccggcccctggggcctcggcccgtaggtaccgaaacggtaccctaccgttccccgaacgagacgttactggaacggccggggctagggaccgaaagggccgacgatagnngnnnnnnnn

SEQ ID NO: 316743 - DNA, 593 bp, Homo sapiens
  misc_feature: GZ8MTXP02HMC87.19.10.A10.1.454.CMB.2.raw
  modified_base (337)..(337): a, c, t, g, unknown or other
  misc_feature (337)..(337): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttccttctgctattttaaaggtgtcctgtgtgaggtgcgcctggtggagtcgtgggggaggcgtggtccagcccggggggtccctgagactctcctgtagaagttatggattcaacttcgctagcggctgggctgtgctgggttcgcccaggctccgaggggaagggctggagtgggtgccgcatcaagnggagatagtggaaaggggagacgacagactacgctgcaccgtgagagcagatttaccatgtacaaagagatgaacttcaaacaaagtacagtgtaatcgtagacaaatagaacgaagaccgtagaagaaccgaacggaacgaacagaccacttactaatagtaactaaaatagtaaataacgtaggggaacgggggaaaaggttaacgggacggacggaaccgtacggtacgtccgtacgtccgttcgacgacccg

SEQ ID NO: 316744 - DNA, 574 bp, Homo sapiens
  misc_feature: GZ8MTXP02FGBVS.19.10.A10.1.454.CMB.2.raw
  modified_base (258)..(258): a, c, t, g, unknown or other
  misc_feature (258)..(258): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (446)..(446): a, c, t, g, unknown or other
  misc_feature (446)..(446): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtctgggggaggcgtggtccaggcccggggggtccctgagactctcctgtagaagttanggattcaacttcgctagcggctggctgtgctgggttcgccaggctccagggaagggctggagtgggtgcgnatcaagagagatatggaaggggagcganagactaccgctgcatcgngagngcagtatttaccatgtacaagagatgattacaacaaaagtacagtagtaatctagcaaaatgaaacngaccagaaagaccgaggacacagaccaattactatagtaacaaaatgtaaatacgtagggggaaccgggggtaaaaattcgggggaaccaaggggaaaccccgtgggtcctccgtcgtcgtcaaccgg

SEQ ID NO: 316745 - DNA, 568 bp, Homo sapiens
  misc_feature: GZ8MTXP02GM96S.19.10.A10.1.454.CMB.2.raw
  modified_base (383)..(383): a, c, t, g, unknown or other
  misc_feature (383)..(383): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgagggaaggggctggagtgggttggccgcatcaagaggagatagtggaaggggagcgacagactacgctgcaccgtgagnggcagatttaccatgacaaagagtatgattacaaacaaagtacagtagtatctagacaaatgaaacagctagaacgaccgaagacacagcctaatttactattagaacaaaatgaaatacggtagggggaacggggtaaagtcggggacgagggtaaccgtggtctacgtcgtcgtcgacgtccc

SEQ ID NO: 316746 - DNA, 522 bp, Homo sapiens
  misc_feature: GZ8MTXP02FHUMM.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (382)..(382): a, c, t, g, unknown or other
  misc_feature (382)..(382): n is a, c, g, or t
  modified_base (494)..(494): a, c, t, g, unknown or other
  misc_feature (494)..(494): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctcctcgttanggtgcgtccaccagggccactggcatcccccganaggttcaggtggcagtgtgtctgggacagacttcactctcaccatcagcagactggacncctagaagtacttttgactagtgtattactgtacaacgtatatgatgagtcaccgtcgtggtggactagttcggccgaggggacaaggtagaagtacgaaacgactgtcgcngcaacgatctcgtctcacgtccttcccg

SEQ ID NO: 316747 - DNA, 554 bp, Homo sapiens
  misc_feature: GZ8MTXP02HWLY6.19.10.A10.1.454.CMB.2.raw
  modified_base (193)..(193): a, c, t, g, unknown or other
  misc_feature (193)..(193): n is a, c, g, or t
  modified_base (376)..(376): a, c, t, g, unknown or other
  misc_feature (376)..(376): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagctaccttcttgcctggtaccagcagagacctggccaggctcccaggctcctgttatggtgccgtccaccgaggggcccacgtcggccacgtcccccggatagggtttcaggtggcagtgtgtcgtgggacagacttcactctcnccatcagcaagctggacgcctagaagtatttgactagttgtattactgtacaacgtatatgatgtagtctaccgtccgtggtggacgtagttcggcgtaggggaccgtaaagggttacgaaaggtacaaaacgtactagtcggactgacaacgtactctcgtcttacacttcgtcccg

SEQ ID NO: 316748 - DNA, 580 bp, Homo sapiens
  misc_feature: GZ8MTXP02I9ZLX.19.10.A10.1.454.CMB.2.raw
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcgccaggctcgagggaggctggagtggtgcgnancaagaggagatagtggaaggggaggacgacagactaccgctgcaccgtgagaggcagactttaccatgtacaaganatagattacaaacaaagtacagtgtaatctagacaaaatgaaacagacctagaaacgaccgaagacacgagacctatttacattagaaacaaatagaaagtacggtagggggaaacggggtaaagtacgggggaccaaggggaacccgtggtaccgtcccggtctccgtcacggtacccc

SEQ ID NO: 316749 - DNA, 537 bp, Homo sapiens
  misc_feature: GZ8MTXP02JT98S.19.10.A10.1.454.CMB.2.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagctaccttntttgcctggtaccagcagagacctggccaggcctcccaggctcctcgtttanggtgcgtccaccgagggccacgtggcatccccganaggttcagtgcagtgngtctgggacagacttcactctcnccatcagcagctggacgctgatntttgctagtgtattactgtacaacgtatagtgatagagtcaccgtcgtggtggacgtagtttcggacgaggggtaccgtaagggttacgaagtacgaaacgtacgtagtacggctagctaacgagtcctagtcttctacgtactcccg

SEQ ID NO: 316750 - DNA, 610 bp, Homo sapiens
  misc_feature: GZ8MTXP02I2IYH.19.10.A10.1.454.CMB.2.raw
  modified_base (366)..(366): a, c, t, g, unknown or other
  misc_feature (366)..(366): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggttcgccaggctccgaggggaaggggctggagtgggttggccgcatcaagaggagatagtggaaggggaggcganagactacgctgcaccgtgagaggcagatttaccatgtacaagagatgaattcaaactaaaagtacagttgtaatctagacaaatgaaacagacctagaaacgaccggaagaactacgagacctaatttactattagtaaacaaaattggaaattacgggtaaggggggaaaccgggggtaaaagttcgggggaccaaacgggggaacccgtgggtacctcccggtcgtccgtcgacgtaccccg

SEQ ID NO: 316751 - DNA, 617 bp, Homo sapiens
  misc_feature: GZ8MTXP02G6ERL.19.10.A10.1.454.CMB.2.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagctaccttcttgcctggtaccagcagagaccctggccaggctcccgaggcctcctcgttatggtcgcgtcccaccgagggcccacgtcggccaactcccccganaggttccaggtgcagtgngtctgggacagtacttcactctcaccntcagcagactggacncctagaagtatttgactagtgttattacgtgtacaacgattaagtgtaagtgtacgtaccgtaacccgttccggtaggtaggacgtagtttacgggaccgtaagggggtaaccctaaaggggtttagaaaacggtacctaaaacgggtaaacgttaggtacggtcgttacggactaacccgtacgttaccgttcgtacctttacacgtttaccctttccccg

SEQ ID NO: 316752 - DNA, 565 bp, Homo sapiens
  misc_feature: GZ8MTXP02H4BZ2.19.10.A10.1.454.CMB.2.raw
  modified_base (307)..(307): a, c, t, g, unknown or other
  misc_feature (307)..(307): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagcaccttcttgcctggtaccagcagagacctggccaggctcccgaggcctcctcgtttanggtcgccgtccacgacgggcccacgtggcacgtccccgagtaggttcccaggtcggcaggttgtggtctggggacagtaccttcactctacaccatcagcagacgtggacgccgtagaacgtatttgactagtagttacttacgtgtacaacgtatagtgatagactacctacgtcgtggtacgtacgtagtttcggaccgtaagggtaccgtaaggttagaacgtaacgaaaacgaacgtggtagctacgtacaacg

SEQ ID NO: 316753 - DNA, 615 bp, Homo sapiens
  misc_feature: GZ8MTXP02HI4HB.19.10.A10.1.454.CMB.2.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtcttgacccctggggaaagagccaccctctcctgcagggccgataagagtgttgacagcacttcttgcctggtaccagcagagacctggccaggcctcccgaggcctcctgttanggtcgcgtccacgagggccactggcatccccganaggttcagtgcagtgtgtctgggacagtctcactcncaccntcagcagctggacnctagaacgtntttgactagtgtaactttactgtaactaacgtatacgtagagttgtaacgtacctaccgttcgggtggttacgaacttagttcggaccggtaacggggtaactaaaggggtttcaaaacgggtttaacgaaaaacccgtaggttacggttacgggcccgtttagaacccgtaaccgttacgttacccttcggttaccgtttacctaaccgtttcccgtttaacccccg

SEQ ID NO: 316754 - DNA, 589 bp, Homo sapiens
  misc_feature: GZ8MTXP02HP8QC.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggaaggggctggagtgggttggccgcatcaagaggagatagtaggaaggggaggacgacgagactaccgctgcaccgtgagagcagtattaccatgtcaaagagatgattcaacaaagtacagtgtatctagacaaatgaaacagctagaacgacggagacacgacgactatttaactattagtaaactaaatagtaaagtacggtaagggggaaacggggtaaaagtcgggaccggaacgggtaacccgtggtaccgtccgtacgttccgacacgtacccg

SEQ ID NO: 316755 - DNA, 519 bp, Homo sapiens
  misc_feature: GZ8MTXP02FTCWT.19.10.A10.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
tcagtactctcgtgcacgaccggtgctcgatttagcgtcgatctcagggggagctgctcagttaggacccagagggaaccatggaaaccccagcgcagcttctcttcctcctgccactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgttanggtncgtccaccagggccactggcatccccganggttcagtggcagtgtgtctgggacagacttcactctcnccatcagcagactggancctgagtatttgctagtgtattactgtcaacgatatgatgatcacctccgtggtggactagtttggaccgtaggggaccaagggttcgaagtacaaacgtactgtacggctgacaaccgatctacgtcttcactcttcccg

SEQ ID NO: 316756 - DNA, 523 bp, Homo sapiens
  misc_feature: GZ8MTXP02IRPDA.19.10.A10.1.454.CMB.2.raw
  modified_base (193)..(193): a, c, t, g, unknown or other
  misc_feature (193)..(193): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagcccaccctctcctgcagggccataagagtgttgacagcaccttctttgcctggtaccagcagagacctggccaggctcccaggctcctcgttatggtgccgtccaccagggccactggcactccccganggttccagtggcagtgtgtctgggacagacttcactcncnccatcagcagactggacncctgaagtatttgctagtgtattactgtacaacgatatgatgagtcactccgtgtgactgttggccgaggggacaaggttagaagtacaaacgtaactggtacgactgacaaccgtatcgtcgtcttcacttccgttcccg

SEQ ID NO: 316757 - DNA, 644 bp, Homo sapiens
  misc_feature: GZ8MTXP02HACFP.19.10.A10.1.454.CMB.2.raw
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (383)..(383): a, c, t, g, unknown or other
  misc_feature (383)..(383): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttctgacgcagtctccaggcaccctgtctttgacccctggggaaagngccaccctctcctgcagggccataagagtgtgacagctacttnttgcctggtaccagcagagacctggccaggcctcccgaggccttccgtcgtttatggtcgccgtcccaccgagggccacgtggccactccccgatggttcaggtgctagtgtggtctacgggacagtacttcacttcctacaccgtntcagtcagactgggaacgtccgtagaagtatttgctagttagttattacgtagtacaaacgtatagtagtatagtacgtcctaccgttccggtaggtacggtaccttaggtttacgggaccggtaagggggtaaccgttaaaagggttacggtaaaacggtacgtaaaaaccggtaacggttacggtacggggtaccttggaacctaacccggtattacccgtacgtttacctttacccgtacctttacccgttcccccgg

SEQ ID NO: 316758 - DNA, 535 bp, Homo sapiens
  misc_feature: GZ8MTXP02F310Y.19.10.A10.1.454.CMB.2.raw
  modified_base (409)..(409): a, c, t, g, unknown or other
  misc_feature (409)..(409): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(535): a, c, t, g, unknown or other
  misc_feature (528)..(535): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctagaagaccgaggacacagccatttactattgtaacaaatgaatacgtggggaacgggggaaaagttggggaccagggaaccctggtcctccgtctcgtcacgcctccaccgaacgggcccagtccggtccttcccccgtggccncccctgccctccgaggcgcaccctcgagacgcacagccggccctggggcctgccctgggcaaacggcctactccccgaagagagtacgngacgcgggncggacacggcgtacagngngnnnnnnnn

SEQ ID NO: 316759 - DNA, 564 bp, Homo sapiens
  misc_feature: GZ8MTXP02HAP7Y.19.10.A10.1.454.CMB.2.raw
  modified_base (334)..(334): a, c, t, g, unknown or other
  misc_feature (334)..(334): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcgagggccgataagagtgttgacagcacttcttgcctggtaccagcagacgacctggccaggctcccgaggcctccgtcgtttatggtgccgtcccaccgagggcccacgtgaccactccccganaggttcaggtggcagtgtgtctggggacagtacttcactcncacatcagcagactgggacncgngaagtatttgctagttagtatactgtacaagtatatagagtgtagtctaccgtcgtggtaggacttaggttcggaccgtaggggaccgtaaggtacggaaagtacgaaaacgacgtaggtacggtctacgacctaacgacgtctacgtcttacacgttccttcccg

SEQ ID NO: 316760 - DNA, 540 bp, Homo sapiens
  misc_feature: GZ8MTXP02GK4DF.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (365)..(365): a, c, t, g, unknown or other
  misc_feature (365)..(365): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttctttgcctggtaccagcagagacctggccaggctcccaggctcctcgttanggtgccgtccaccagggccacgtggccatccccganaggttcagtggcagtgtgtctgggacagacttcactctcnccatcagcagactggacgcctgaagtatttgctagtgtattacgtgtacaacgatatgatgagtcaccgtccgtggtagactagtttggccgtaggggacctaagggttacgaaagtacgaaacgtaacgtgtacggcgtacgcaacgtactctacgtcttacacttccttcccg

SEQ ID NO: 316761 - DNA, 533 bp, Homo sapiens
  misc_feature: GZ8MTXP02JJ27X.19.10.A10.1.454.CMB.2.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagtactctcgtgcacgaccggtgctcgatttagcgtcgatctcaggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagcaccttctttgcctggtaccagcagagacctggccaggctcccaggctcctgttanggtgcgtcccacagggccacgtggcatccccganaggttcagtgcagtgtgtctgggacagacttcactctcnccatcagccagactggacgcctgaagtactttgctagtgtattacgtgtacaacgtataatgatgagtactaccgtccgtggtcggactgttggaccgaggggacctaagggttcgaagttacgaaacgtactaggcgacgtgacaacgtctactgtctactacttcgtacccg

SEQ ID NO: 316762 - DNA, 559 bp, Homo sapiens
  misc_feature: GZ8MTXP02HV9BI.19.10.A10.1.454.CMB.2.raw
  modified_base (514)..(514): a, c, t, g, unknown or other
  misc_feature (514)..(514): n is a, c, g, or t
  modified_base (529)..(529): a, c, t, g, unknown or other
  misc_feature (529)..(529): n is a, c, g, or t
  modified_base (551)..(559): a, c, t, g, unknown or other
  misc_feature (551)..(559): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaaacagcctgaagaccgaggacacagccatttactattagtaacaaaatgaatacgtagggggaacgggggaaaattggggaccaaggggaccctggtccctccgtctcgtcagccctccaccgaagggcccagtccgttctccccctggcccgccctgcctcaggacgccacctccgagacgcacgacgccggccctgggctcggccgtgggtaccgaacggacctaccttccccgaacggtacgacgttacgngacgggccgggtacncgggacaaacggccgacatagnnnnnnnnn

SEQ ID NO: 316763 - DNA, 678 bp, Homo sapiens
  misc_feature: GZ8MTXP02H6XN5.19.10.A10.1.454.CMB.2.raw
  modified_base (363)..(363): a, c, t, g, unknown or other
  misc_feature (363)..(363): n is a, c, g, or t
  modified_base (418)..(418): a, c, t, g, unknown or other
  misc_feature (418)..(418): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtgggtccaggcccggggggtcctgacgactctcctgtagaagttatggattcaacttcgctagcggctggctgtgcgtgggtcgccgaggctccgagggaggggctgggagtgggttggccgcatcaaagaggagataagtggaaaggggngacgacgagactaaccgctgcaccgtgagaggcagtaattaccatgtacaaaganatagattacaacgtaaaagtacaagttagtaatacgtagacaaaatgaaacgagaccgtaagaaacgaccggaaagggacaaacgacgtaccctaattttaacctaagtttacgtaaaactaaaagtaggtaaaacgttaacgggtaagggggggtaaaaccgggggtaaaaaggttccgggggaacccggtaaacgggggtaaaccccgttcggggtacccgttacccggtccgttaccgggtacaccggtaacccccg

SEQ ID NO: 316764 - DNA, 592 bp, Homo sapiens
  misc_feature: GZ8MTXP02GL0VU.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccagggaaggggctggagtgggttggccgcatcaaagaggagatatggaaggggaggcgacagactacgctgcacccgtgagaggcagatttaccatgtacaaagagatgaattcaaacaaagtaacagtgtaatctagacaaatagaaacagcctagaagaaccgagaacacagccaatttacaattagtaactaaaatagaaataacgtagggggtaaacgggggaaaaagttacgggggaccgaaggggaaaccccgtggtaccgtcccgtcgtcgtccaggaccccg

SEQ ID NO: 316765 - DNA, 619 bp, Homo sapiens
  misc_feature: GZ8MTXP02FNEDP.19.10.A10.1.454.CMB.2.raw
  modified_base (331)..(331): a, c, t, g, unknown or other
  misc_feature (331)..(331): n is a, c, g, or t
  modified_base (392)..(392): a, c, t, g, unknown or other
  misc_feature (392)..(392): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagcaccttcttgcctggtaccagcagagacctggccaggctcccaggctcctcgtttatggtcgccgtccaccgagggcccacgtcggcactcccccganaggttccaggtggcagtgtcgtctggggacagtcttcactctcaccatcagcagactggancctgaatatttgctagtgtattacgtgtacaaacgattagtagatagacgtcctaaccggttccggtgggttacggacgttaggtttcgggaccggtaagggggtaaccgtaaaggggttacggtaaaggtaaccgaaaacggtaaccgtgggttacgggaccgtacggaccctaaccggtacttccggttcgttaccgtttccgtaacctttcccgtttacccccg

SEQ ID NO: 316766 - DNA, 595 bp, Homo sapiens
  misc_feature: GZ8MTXP02GJEJA.19.10.A10.1.454.CMB.2.raw
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(592): a, c, t, g, unknown or other
  misc_feature (590)..(592): n is a, c, g, or t
  modified_base (594)..(595): a, c, t, g, unknown or other
  misc_feature (594)..(595): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccacatcaagaggagatatgaaggggaggcgacagactacgctgcacccgtgagaggcagatttaccatgtcaagagatgattcaacaaagtacagtgtatctgacaaatgaacagcctgaagaccgaggacacagcctaatttactattgtaacaaatgaatacgtaggggaacgggggaaaattggggaccgagggaaacccctggtacccctccgtctcgtcacgccctccaccgaacgggccctagtccgtcccttcccccgtgggccctccctgcctccgaaggcgccaccctcgagacgccaacgcgccggccctggggcctgccgtcgggtaccaaaacgggccttaccgttaccccgaaggtaacgaacggtttaccgacgggaaggcccggggatacggggaccaaagggggccaccgtaaatagaagngncnnncnn

SEQ ID NO: 316767 - DNA, 598 bp, Homo sapiens
  misc_feature: GZ8MTXP02HA0NX.19.10.A10.1.454.CMB.2.raw
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
  modified_base (510)..(510): a, c, t, g, unknown or other
  misc_feature (510)..(510): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgctgggtcgccaggctccgagggagggctggagtggggtggccgcatcaaggaggagatagnggaaggggaggacgacagactaccgctgccaccgtgagaggcagtattaccatgtacaaagngatgaattacaacaaaagtacagtcgtatctagacaaatgaaacagcctagaaacgaccggaagaccagtacgacctaatttactattagaaactaaanagtaaagtacgggtagggggaaacgggggtaaaagtcgggggaccaacggggtaacccgtggtacctcccgatccggtacacgacccg

SEQ ID NO: 316768 - DNA, 584 bp, Homo sapiens
  misc_feature: GZ8MTXP02GQXXX.19.10.A10.1.454.CMB.2.raw
  modified_base (409)..(409): a, c, t, g, unknown or other
  misc_feature (409)..(409): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgcaggctccgagggaagggctggagtgggttggccgcatcaaaggaggagatagtggaaggggagacgacagactaccgctgcaccgtgagagcagatttaccatgtacaaaganatgattcaaacaaagtacagtgtatctagacaaatagaacagctagaacgaccgagaacacagacctattacattagaactaaaatgaaatacgtagggggaaacgggggtaaaattcgggggaccgaaacggggaacccgtgggtacctacccggtctacgtcgaacgtccccg

SEQ ID NO: 316769 - DNA, 591 bp, Homo sapiens
  misc_feature: GZ8MTXP02JYXXV.19.10.A10.1.454.CMB.2.raw
  modified_base (541)..(541): a, c, t, g, unknown or other
  misc_feature (541)..(541): n is a, c, g, or t
  modified_base (582)..(582): a, c, t, g, unknown or other
  misc_feature (582)..(582): n is a, c, g, or t
  modified_base (584)..(591): a, c, t, g, unknown or other
  misc_feature (584)..(591): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaagaccgaggacacagccatttactattagacaaaatgaaatacgtagggggaacgggggaaaagttggggaccaggggaacccctggtcctccgtctcgtcacgccctccaccgaacgggcccagtcgtccttccccctggcccgccctgcctcccgaggacgccacccgtcccggaagacgccacgacggccgggcccctggggctcggacccgtggggtaccaaacgggtacccttaaccgttcccccaaaggacggtaagttaccgngggacggccggggactcgggacgaacgggtcgacgaagtangnnnnnnnn

SEQ ID NO: 316770 - DNA, 592 bp, Homo sapiens
  misc_feature: GZ8MTXP02GMVYY.19.10.A10.1.454.CMB.2.raw
  modified_base (416)..(416): a, c, t, g, unknown or other
  misc_feature (416)..(416): n is a, c, g, or t
  modified_base (538)..(538): a, c, t, g, unknown or other
  misc_feature (538)..(538): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(592): a, c, t, g, unknown or other
  misc_feature (586)..(592): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgcaaatgaacagcctgaagaccgaggacacagccatttactattgtaacaaatgaatacgtggggaacggggaaaagttggggaccagggaaccctggtccctccgtctcgtcagccctaccaccgaaacgggccccagtccggtccttccccccgtgggcccncccctgcccttcccgaagggacgcccaccctcccggaagacgccacgacgccggccccgttggggcctcgccctcggggtaccaaacgggaccttaacttcccccgaaagacgagttaccgnggacggccgggacgtcgggacgaacgggccgtacgaagtacggngngnnnnnnn

SEQ ID NO: 316771 - DNA, 552 bp, Homo sapiens
  misc_feature: GZ8MTXP02F5H4F.19.10.A10.1.454.CMB.2.raw
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggcctcctcgtttanggtcgcgtccaccgagggccacgtggcactccccganggttcagtggcagtgtgtctgggacagacttcactctcnccatcagccagactggacnctgaagtatttgctagtgtattactgtacaacgatagtgatagagtccaccgtcgtggtggactagtttcggcgaggggacgtaagggtacgtaagtacgaaacgtaacgtagtacggtctacgaccaaccgtactcgtacgttcctttacgacttccttaccccg

SEQ ID NO: 316772 - DNA, 581 bp, Homo sapiens
  misc_feature: GZ8MTXP02JCGXY.19.10.A10.1.454.CMB.2.raw
  modified_base (405)..(405): a, c, t, g, unknown or other
  misc_feature (405)..(405): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccgggggtccctgagactctcctgtagaagttatggattcaacttcgctagcggctggctgtgctggtcgccaggctccgagggagggctgggagtgggttggccgcatcgaagaggagatagtggaaggggagcgacgagactaccgctgcaccgtgagagcagtatttaccatgtacaagngatgattcaacaaagtacagtagtatctagacaaatagaacagcctagaacgacgagacacagacctatttactactagtaacaaatagaaagtacgggtagggggaaacgggggtaaaagttcgggggaaccgacggggaacccgtggtccgtccgtacgtcgtccgacggtccc

SEQ ID NO: 316773 - DNA, 573 bp, Homo sapiens
  misc_feature: GZ8MTXP02JL7MU.19.10.A10.1.454.CMB.2.raw
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcgccaggctccgagggaagggctggagtgggttggccgcatcaagnggagatagtggaaggggagcgacaggactaccgctgcacccgtgagaggcagatttaccatgtacaaagngatgaattcaacaaagtacagtgatctagacaaatgaactagcctagaacgaccggagacacgagacctatttactattagaacaaatgaaatacggagggggaacggggtaaaagttcggggaccaggggtaacccgtggtacctccggtctcgtcgacgtaccc

SEQ ID NO: 316774 - DNA, 628 bp, Homo sapiens
  misc_feature: GZ8MTXP02J21X5.19.10.A10.1.454.CMB.2.raw
  modified_base (334)..(334): a, c, t, g, unknown or other
  misc_feature (334)..(334): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggccccggggggtccctgagactctcctgtagaagttatggattcaacttcgctagcggctggctgtgctgggttcgccaggctccgaggggagggctggagtgggttggccgnatcaaaggaggagatagtaggaaggggagcgacagactaccgctgcaccgtgagagcagtactttacatntacaaagngatgattacaacaaagtacagtgtatctagacaaatgaacagcctagaagaccgagaccacgtacgacctatttactaattacgtaactaaaataggtaaagtaacgggtaacggggggtaaacggggggtaaaaacgttcgggggaacccgtaaacgggggtaaacccccgttgggtacccgtcccggttaccgtaccggttcgaacgtcccccg

SEQ ID NO: 316775 - DNA, 605 bp, Homo sapiens
  misc_feature: GZ8MTXP02FZ7GW.19.10.A10.1.454.CMB.2.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagctaccttctttgcctggtaccagcagngacctggccaggctcccaggcctcctcgttanggtcgccgtccaccgagggccacgtggcacgtccccgatcggttcaggtggctaggtgtgtcgcgggacagacttcactctcaccntcagcagacgtggacncctagaagtatttgntagttgtacttactagtacaaacgtatagtagtactgacgtacctaccgtaccggtggtacggtacgtagtttcgggaccggtaagggggtaaccgtaagggttacggaaacggtacgaaaacggtaacgttaggtacggtacgtacggaccaaccgtaactcgttacggttcttaccgtacttacccgtttccccg

SEQ ID NO: 316776 - DNA, 517 bp, Homo sapiens
  misc_feature: GZ8MTXP02I156L.19.10.A10.1.454.CMB.2.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (508)..(508): a, c, t, g, unknown or other
  misc_feature (508)..(508): n is a, c, g, or t
  modified_base (510)..(517): a, c, t, g, unknown or other
  misc_feature (510)..(517): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccacatcaagaggagatatgaaggggaggcgacagactacgctgcacccgtgagaggcagatttaccatgtcaagagatgattcacaaagtacagtgtatctgcaaatgaacagcctgaagaccgaggacacagccattactattgtaacaaaatgaatacgtgggggaacggggtaaaattggggaccaggggaaaccctggtccctccgtctcgtcacgcctccacgaacgggcccagtccgtctcccccgnggccnccctgctccaggcnccactccgagacgcacagccgcccgtgggctgcctggcaaggctactccacganagtacngacgcgggctcggcaaggcacgatagngnnnnnnnn

SEQ ID NO: 316777 - DNA, 574 bp, Homo sapiens
  misc_feature: GZ8MTXP02F8NQB.19.10.A10.1.454.CMB.2.raw
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgagggaagggctggagtgggttgcgcatcaagaggagatatggaaggggaggcganagactaccgctgcaccgtgagagcagattaccatgtacaaaganatgattacaaacaaagtacagtgtatctgacaaatgaaacagcctagaacgaccgagacacagcctaatttacattagaacaaaatgaaatacggtagggggaaacgggggtaaaattcgggggaccaaggggaaccctgggtacctaccggtctcggtacacgtacccc

SEQ ID NO: 316778 - DNA, 572 bp, Homo sapiens
  misc_feature: GZ8MTXP02FWVQ0.19.10.A10.1.454.CMB.2.raw
  modified_base (347)..(347): a, c, t, g, unknown or other
  misc_feature (347)..(347): n is a, c, g, or t
  modified_base (402)..(402): a, c, t, g, unknown or other
  misc_feature (402)..(402): n is a, c, g, or t
  modified_base (510)..(510): a, c, t, g, unknown or other
  misc_feature (510)..(510): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccgaggggaaggggctggagtgggttgccgcatcaagaggagatangaaggggagcgacagactacgctgcaccgtgagaggcagatttaccatgtcaagngatgattcaacaaagtacagtgtaatctgacaaatgaaacagcctagaaacgacccggaaggaccacgtagcccttaattactattagtaacaaaatgaaattaacgngggggaaacgggggaaaattcgggggaccaggggaaccctggtactcggtctcgtcagcccc

SEQ ID NO: 316779 - DNA, 539 bp, Homo sapiens
  misc_feature: GZ8MTXP02G5EAQ.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccgataagagtgttgacagcaccttcttgcctggtaccagcagagacctggccaggctcccaggctcctcgtttanggtncgtccacagggccacgtggcactccccganaggttcagtgcagtgngtctggggacagtacttcactcncaccatcagcagactgggacgcctgaagtatttggactagtagtattactgtacaacgatatgatgagtcacgtcgtggtgactagttcggacgaggggaccaaggttagaaagtacgaaaacggtactaggtcggctaggaccaaccgtatctacgtcttacacttaccttccccg

SEQ ID NO: 316780 - DNA, 625 bp, Homo sapiens
  misc_feature: GZ8MTXP02J1DN5.19.10.A10.1.454.CMB.2.raw
  modified_base (345)..(345): a, c, t, g, unknown or other
  misc_feature (345)..(345): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtgggtccaggccccggggggtccctgagactctcctgtagaagttatggattcaacttcgctagcggctggctgtgctgggtcgccaggctccgagggagggctggagtgggtgcgcatcaagaggagatagnggaaggggaggcgacgagactaccgctgcacccgtgacggaggcagattaccatgtacaaagagatgattcaacaaaagtacaggtntatctagacaaatggaaacngacctagaaacgacccggaagacctacgacgaccctaatttaacctatttagaaactaaaagtagaaacgtaccggggtaaggggggaaaaccggggggtaaaagttcggggggaaccgtaacgggggaaccccgtgggtaccgtccggtcctccggttcgaacggtcccccg

SEQ ID NO: 316781 - DNA, 547 bp, Homo sapiens
  misc_feature: GZ8MTXP02FLG34.19.10.A10.1.454.CMB.2.raw
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
  modified_base (289)..(289): a, c, t, g, unknown or other
  misc_feature (289)..(289): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagcaccttnttgcctggtaccagcagagacctggccaggctcccgaggctcctcgtttanggtgccgtccaccgagggccacgtggccactccccgataggtcagtggcagtgtgtcgngggacagacttcactctcnccatcagcagacgtggacncctagtaacgttatttgactagttgtacttactgtacaaagtatagagatgacgtcaccgttcgtggtagactagttcggacgtagggacgtaagggttagaacgtacgaaacgtagtgtcgactgactaacgtatcgtcgttactctacgtcccttcccg

SEQ ID NO: 316782 - DNA, 572 bp, Homo sapiens
  misc_feature: GZ8MTXP02IX5E2.19.10.A10.1.454.CMB.2.raw
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
  modified_base (293)..(293): a, c, t, g, unknown or other
  misc_feature (293)..(293): n is a, c, g, or t
  modified_base (396)..(396): a, c, t, g, unknown or other
  misc_feature (396)..(396): n is a, c, g, or t
  modified_base (546)..(546): a, c, t, g, unknown or other
  misc_feature (546)..(546): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagctaccttnttgcctggtaccagcagacgaccctggccaggcctccgaggcctcctcgtttanggtgccgtaccaccgagggccacgtggccacgtcccccgaagtaggtttcaggttaggctaggttggtgtcgtacggggacagtaccttcacttctacacctntcaggccaagaccgtgggacgacctagaagtatttgactagtgttattactgtaactagatatatatgtagtactacgtcgtggtacgacgtagttcggacggagggacgtaaggtacgaagtacgaaacgagtagtcgactgactaacngtacttcgtactctacttcctacccg

SEQ ID NO: 316783 - DNA, 610 bp, Homo sapiens
  misc_feature: GZ8MTXP02H6TVH.19.10.A10.1.454.CMB.2.raw
tcagtactctcgtgcacgaccggtgctcgatttagcgtcgatctcaggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgagccccggggggtccctgagactctcctgtagaagttatggattcaacttcgctagcggctggctgtgcgtgggtcgccaggctccgaggggagggctggaggtgggtggccgcatcgaagaggagatagtaggaaggggaggcgaagagactaccgctgccaccgtgagagcagtattaccatgacaagagatgattacaacaaaagtacagtagtatctagacaaaatgaaacagcctagaacgacgagacacagcctaatttacatttagaaactaaatacgaagttaacggtaggggggaaacgggggtaaaaagttcgggggaaccgtaacggggtaaacccgttgggtacccgttcccggtacgtaccggttaccacgtacccccg

SEQ ID NO: 316784 - DNA, 555 bp, Homo sapiens
  misc_feature: GZ8MTXP02I4ZC7.19.10.A10.1.454.CMB.2.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctccaggcaccctgtcttgaccctggggaaangccacctctcctgcagggccataagagtgtgacagctaccttnttgcctggtaccagcagacgacctggccaggcctcccaggctcctcgtttatggtgccgtccaccgagggcccacgtcggccaacgtcccccgaagtacggttcccaggttggctaggtgtgtcgtggggacagtaccttcactctcaccatcagcagactgacgcctagaacgtatttagctagtgtaattacgtgtacaacgtatatgatgagtcacgtcgtggtacggactagttcggaccgagggaccgtaagggttgaaacgttaacgaaaacgtaacgtcggtacggactacggactaacg

SEQ ID NO: 316785 - DNA, 548 bp, Homo sapiens
  misc_feature: GZ8MTXP02HQKTG.19.10.A10.1.454.CMB.2.raw
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (403)..(403): a, c, t, g, unknown or other
  misc_feature (403)..(403): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttcttgcctggtaccagcagagacctggccaggctcccaggcctcctcgttanggtgcgtcccaccgagggcccacgtggccatcccccgaanagggtttcaggtggcaggtgtgtctggggacagacttcactctcaccatcagcagactggacgcctagaaagtntttgctagtgtattactgtacaacgtatatgatgagtcacctcgtggtgactagttcggccgtaaggggaaccgtaagggttagaaagtacgaaaacgtaacgtcgtagctgaccaactactctacgtcttacacttcctccccg

SEQ ID NO: 316786 - DNA, 688 bp, Homo sapiens
  misc_feature: GZ8MTXP02GCVMO.19.10.A10.1.454.CMB.2.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgaggggaaggggctgggagtggggcgtcgggccagtcgacgaagagganatgaggaggngagagagaccgcncgcaccgtcgagagcgagagttactactagtacgaagagtaatagtagtactaacgaaacgtaaacgtagtagtagtagtacgtacgaacgtaagaacgaacgacgacgaacgaacggaacgaacgacgacgaacgtaacgttaacttaacgttaacgttaacgtaaaacgtaaacgtaaagttaaacgggttaaacgggggtaaacgggggtaaaacgggggttaaacggggtaaccggggtaaaccggggtaaaccgggttaaccggttaccggttacccggttacccgttaccggttaccgtaccgtacccg

SEQ ID NO: 316787 - DNA, 609 bp, Homo sapiens
  misc_feature: GZ8MTXP02GIFT1.19.10.A10.1.454.CMB.2.raw
  modified_base (457)..(457): a, c, t, g, unknown or other
  misc_feature (457)..(457): n is a, c, g, or t
  modified_base (557)..(557): a, c, t, g, unknown or other
  misc_feature (557)..(557): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(609): a, c, t, g, unknown or other
  misc_feature (602)..(609): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaaacagcctagaaacgaccgaaggacacagcctatttactattagtaacaaatgaaatacggtaggggggaaacgggggtaaaagttcggggaccgaacggggaaccctgggtacccctccgtctcgtcacgccctaccaccgaacgggccccagtccgtcccttcccccgtggcccgccctgccctcccgaggacncccaccctccggagacgccacgcggcccggccccgtggggcctcggcccgtggggtaccaaacgggtcccttaccgtccccgaaggtacgacggttacgngggacggccggggacgtacggggacgaacgggccgacaagngngnnnnnnnn

SEQ ID NO: 316788 - DNA, 628 bp, Homo sapiens
  misc_feature: GZ8MTXP02JMSNM.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtggtcgccaggctccgagggagggctggaggtggggtggccgcatcaaggaggagatagtaggaaggggaggacgacgagactacgctgccaccgtgagaggcagtattaccatgtacaaagagatgattcaacaaagtacagtgtatctagacaaatagaacagaccgtagaacgacgaacggaacacgacgacctatttacgtattacgaactaaataagtaaagtacggggtaaagggggtaaacgggggtaaaacggttacgggggaacccggaaacggggtaacccggttacggttcccgttacccggtccgttaccggtaccacggtacccccg

SEQ ID NO: 316789 - DNA, 539 bp, Homo sapiens
  misc_feature: GZ8MTXP02INZXB.19.10.A10.1.454.CMB.2.raw
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagcaccttctttgcctggtaccagcagagacctggccaggctcccaggctcctcgtttanggtgcgtcccacagggccactggcactccccganggttcagtggcagtgtgtctgggacngtacttcactctcnccatcagcagactggacgctgaagtatttgctagtgtattactgtacaacgatatgatagagtcaccgtccgtggtcgagtagttcggcgaaggggactaaggttacgaagtacgaaacggtatacggtcggactgacctaacgtactcgtacgttctctacttccttaccccg

SEQ ID NO: 316790 - DNA, 591 bp, Homo sapiens
  misc_feature: GZ8MTXP02GTFF2.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgagggaaggggctggagtgggttggccgcatcaagaggagatagtaggaaggggaggcgacgagactaccgctgcacccgtgagaggcagtattacatgtacaagagatgattcaacaaagtacagtgtatctagacaaatgaacagcctagaacgaccgagaacacgacgacctaatttacaattagtaaacaaaagtacgaaagtacggtagggggaaacgggggtaaaacgtcgggggaccaggggtaacccgtgggtaccctcggtactccggtacacgtcccc

SEQ ID NO: 316791 - DNA, 645 bp, Homo sapiens
  misc_feature: GZ8MTXP02IQ556.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggttcgccaggctccgaggggaaggggctggaggtgggttggccgcatcaaggaggagatagtggaaggggaggcgacagactaccgctgcaccgtgagaggcagtattaccatgtacaagagatgattacaacaaagtacagtgtaatctagacaaatagaaacagacctagaacgacggaagaccacagcctaatttactagttagtaactaaaagtagtaaaacgtacgggttaacggggggaaacggggggtaaaacggttacggggggaacccgtaaacgggggtaaacccccgtttcgggggttaaccccgttcccggttaccgtacccggttaccgaaccgtccccccgg

SEQ ID NO: 316792 - DNA, 603 bp, Homo sapiens
  misc_feature: GZ8MTXP02H403Z.19.10.A10.1.454.CMB.2.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgaccccctggggaaanagcccaccctctcctgcagggccgataagagtgttgacggctaccttcttgcctggtaccagcagagacctggccaggctcccaggcctcctcgtttanggtcgcgtccaccgagggcccagtggcacctccccganaggttcagtggcagtgtgtcgtggaccagcttcactctcaccntcagcagactggganccctagaagtatttgactagtagttattactagtacaaagtatagtagtagtgtacgttaccgtaccgttccggtaggttaggtaacgtagtttacgggaccggtaacggggtaccgtaaagggttaacgtaaacggtacgaaaacggtaacgtaggtacggcgtacggactaccgtaatcgttacgtccttacgtaccttccttacccgaccc

SEQ ID NO: 316793 - DNA, 631 bp, Homo sapiens
  misc_feature: GZ8MTXP02IA8RZ.19.10.A10.1.454.CMB.2.raw
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtgggtccgaggccccgggggggtccctgagactctcctgtagaagttatggattcaacttcgctagcggctggctgtgcgtggtcgcaggctccgagggagggctggagtgggtggccgcatcaagnggagatagtggaaggggngcganagactacgctgcaccgtgagagnagtattaccatcgtanaaagtagactagaattacaacaaaaggtactagttagtatcgtagacaaaatacgaaacacgtaccgtaaaggaaacggaacccggaaaggaacaaactaacggtaccctaattttaacctaagttagtaaaactaaaagtacgaaggtaacgtaggggggaaacgggggtaaagtcgggggacgaacggggtaaccgtggtaccgtccgtacgtcgtactacgaccccg

SEQ ID NO: 316794 - DNA, 675 bp, Homo sapiens
  misc_feature: GZ8MTXP02IMNX2.19.10.A10.1.454.CMB.2.raw
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgaccccctggggaaagagcccaccctctcctgcagggccataagagtgttgacagcacttcttgcctggtaccagcagacgacctggccaggcctcccgaggcctcctcgtttatcggtgccgtcccaccgacgggccacgtggccacgtccccgatacggtttcaggtggcagtgtgtcgtaggggacacgtacttcactcctcacctatcagccagtacgtaggacgtcctaggaaagttattttacggcgttaaggttagttaacgtttacgttacgtaaccgaaacggtattaagtaggtaatacgggtaacgttacccgtaaccggttcccgggttagggtacggtaaccgttaggttttacgggacccggtaaagggggacccgttaaagggtttacggaaaacggttaacgaaaacggtaaacgtggtacggtacgttacgaccgtaaccgtacttccgttacgttacttacctacttcccgttaccccg

SEQ ID NO: 316795 - DNA, 639 bp, Homo sapiens
  misc_feature: GZ8MTXP02HIN48.19.10.A10.1.454.CMB.2.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
tcagtactctcgtgcacgaccggtgctcgatttagcgtcgatctcagggggagttgctcagttaggacccagagggaaccatggaaaccccagcgcagcttctcttcctcctgctactctggctcccagatagcaccggagaaattttctgacgcagtctccaggcaccctgtctttgacccctggggaaanagccaccctctcctgcagggccgataagagtgttgacagctaccttnttgcctggtacccagcagacgaccgtggccaggcctcccgaggtcctccgttcgtttagnggtcgccgtccaaccgacgggccacgtcggcaccgtccccgatacggttcaggtcggctagtgtgtcgtgggacctagcttcactctacactcncagcgagcgtgactcgtagtagttagttagagtagtagttacttacgtacgtaacgtaagtattagtagtattacggtacgtacccgtaccggttcgggtaggtacgtacgttacggttacgggaccggtaaacggggtaaccgtaaagggttacgtaaacgtaacgaaacggtacgttaggacggtacgacgtaccgtaaccgtcgttcgttacgttacctacgtaccgttacccgtacccgtac

SEQ ID NO: 316796 - DNA, 603 bp, Homo sapiens
  misc_feature: GZ8MTXP02HGYR6.19.10.A10.1.454.CMB.2.raw
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagctacttcttgcctggtaccagcagagacctggccaggctcccgaggcctcctcgtttatggtcgccgtccaccgagggcccacgtggcacgtccccganaggttccagtagctagtgtgtcgtgggacagtacttcactctcaccatcagcagactgggacncgtagaagtntttgctagtgttatacgtgtacaaacgtattagtgtatcgtagtacctacccgtcggtaggtacggtacgttaggtttacggaccggtaacggggtaaccgtaaggggttaacgaaacggttacgaaaacggtaacgtcgggtacgtacgtagacctaacgtacttacgttcgttacttacctactttacccgttccccg

SEQ ID NO: 316797 - DNA, 565 bp, Homo sapiens
  misc_feature: GZ8MTXP02ISYGG.19.10.A10.1.454.CMB.2.raw
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (512)..(512): a, c, t, g, unknown or other
  misc_feature (512)..(512): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(565): a, c, t, g, unknown or other
  misc_feature (561)..(565): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgcaaatgaacagcctgaagaccgagacacagccatttactattgaacaaatgaatacgtaggggacgggggaaaattggggaccaggggaaccctggtccctccgtctcgtcagccctccaccgaacgggcccagtccgtccttcccccgnggccgcccctgcctcccgaggacnccaccctccgagacgcacacgccggccctggggccttgccctgggtaccaaacgggacctaccttcccgacgtaacgagttaccgnggacggcggggctcgggaaccgaagggtcccgaacacgtagngngcncnnnnn

SEQ ID NO: 316798 - DNA, 601 bp, Homo sapiens
  misc_feature: GZ8MTXP02GMNY5.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgcgtgggttcgccaggctccgaggggaaggggctggagtggggtggccgcatcgaagaggagatagtggaaggggaggcgacagactacgctgcaccgtgagaggcagtactttaccatgtacaaagagatgattcaacaaagtacagtgtatctagacaaatgaaacacgacctaggaacgaccggaaggaccagacgcctaatttactattagtaaacaaaatagaaagtacgggtagggggaaacgggggtaaaagttcgggggacccaaggggtaacccgtggtaccgtccggtctccggtcgacgtccccg

SEQ ID NO: 316799 - DNA, 616 bp, Homo sapiens
  misc_feature: GZ8MTXP02FNTU0.19.10.A10.1.454.CMB.2.raw
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccggggggtcctgagactctcctgtagaagttatggattcaacttcgctagcggctggctgtgcgtgggttcgccaggctccgaggggaggggctgggaggtggggttggccgcatcgaaggaggagatagtggaaggggagcganagactacgctgcaccgtgagaggcagtatttaccatgtacaagagatgaattcaaactaaagtacagtntatctgacaaatacgaaacagcctagaaacgaccgaggaccacgacgctaatttactattacgtaaacaaaagtgaaagttacgggtaaggggggaaacgggggtaaaagttcgggggaccgtaaacgggggaacccgttgggtacccgtaccgtacgtccggtacacggtaccccg

SEQ ID NO: 316800 - DNA, 616 bp, Homo sapiens
  misc_feature: GZ8MTXP02IMRTU.19.10.A10.1.454.CMB.2.raw
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgaccccgtggggaaagagcccaccctctcctgcagggccgataagagtgttgacagctaccttcttgcctggtaccagcagacgacctggccaggcctcccgaggccttccgtcgtttagtggtcgccgtcccaccgaggggcccacgtggccacgtcccccgagacggtttccaggtggctagtgtgtcgtgggacagtacttcactctcacatcagcagactggagcctagaagtatttgctagttgttacttatcgtacaaacgtatatgtatagtagtcccgtaccgtcccggtgggtacggtacgtaggtttacgggaccggtaagggggtaaccgtaaagggttagtaaacggtaacgaaaacggtaaacgtggtacggtacgtcgaccgtaaccgtactcgttcgttacttcgtacctcccgtttcccccg

SEQ ID NO: 316801 - DNA, 537 bp, Homo sapiens
  misc_feature: GZ8MTXP02F30J0.19.10.A10.1.454.CMB.2.raw
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (529)..(529): a, c, t, g, unknown or other
  misc_feature (529)..(529): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgttanggtgcgtccaccgagggccactggcacgtccccganaggttcagtggcagtgtgtctggggacagacttcactctcnccatcagcagactgggacgcctagaagtattttgctagtgtaattacgtgtacaaacgataatgatgagtcaccgtccgtggtgatagtttcggaccgaggggaccaagggttagaaagtacaaaacgaaacgtcgtaggctgacaaccgtatctgtcttacnctctcccg

SEQ ID NO: 316802 - DNA, 547 bp, Homo sapiens
  misc_feature: GZ8MTXP02GVTF1.19.10.A10.1.454.CMB.2.raw
  modified_base (430)..(430): a, c, t, g, unknown or other
  misc_feature (430)..(430): n is a, c, g, or t
  modified_base (538)..(538): a, c, t, g, unknown or other
  misc_feature (538)..(538): n is a, c, g, or t
  modified_base (540)..(547): a, c, t, g, unknown or other
  misc_feature (540)..(547): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtaacaaaatgaaatacgtgggggaacgggggaaaattggggaccaggggaaccctggtccctccgtctcgtcacgcctccaccgaacgggcccatccggtccttcccccgtggcccgccctgccctccgaggacnccacctccgagacgcacgagccggcccctggggctgccctgggtccaaaggcctacgttcccaacgtagacgtacgtgacggcgggctgggcaagggccgacgatagngnnnnnnnn

SEQ ID NO: 316803 - DNA, 698 bp, Homo sapiens
  misc_feature: GZ8MTXP02JWV70.19.10.A10.1.454.CMB.2.raw
  modified_base (294)..(294): a, c, t, g, unknown or other
  misc_feature (294)..(294): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggccaccctgtctttgacccctggggaaagagccaccctctcctgcagggccgataagagtgttgacagctaccttcttgcctggtaccagcagacgacctggccaggcctcccgaggcctcctgtttanggtcgccgtccaccgagggcccacgtggccacgtcccccgagtacggttcaggtggcagtgtgtctcggggacagtactcactctcacctatcagcagactagggacgtacgtagaaagttagtttgcgtagttagttacttacgttagtacgaaacgtaattaagtaggtagtacggtacgttacccgtaacccggttccgggttagggttacgggtaacgttacggtttacggggacccgggtaacgggggtaaacccggttaaaggggtttaacgggaaaacggttaaccggaaaaaccgggttaacggttacgggttacggtacccggtaacggtaccgtaacccgttacgttaccgtttcggtttacctttaccgtaaccgtttcccgtttacccccgg

SEQ ID NO: 316804 - DNA, 590 bp, Homo sapiens
  misc_feature: GZ8MTXP02IPRP9.19.10.A10.1.454.CMB.2.raw
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtcctgagactctcctgtagaagttatggattcaacttcgctagcggctggctgtgctgggttcnccaggctccagggaaggggctggagtgggttgccgcatcaagaggagatatgaaggggngcganagactacgctgcacccgtgacgaggcagatttaccgatggtacaaagagaatgattcaacaaaagtcagtgtatctgaanaananaanagacagaagacgagacacacgactaacttactatataactaaataagtaaagtaacggtaacgggggtaaacgggggtaaacgggttaacggggtaaccggaacgggtaaccggtacggtacgtccgtccgtacgtacgacgtaccg

SEQ ID NO: 316805 - DNA, 571 bp, Homo sapiens
  misc_feature: GZ8MTXP02JNPYD.19.10.A10.1.454.CMB.2.raw
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcgccaggctcagggagggctggagtgggtgccgcatcaagaggagatagtggaaggggaggcgacagactacgctgcaccgtgagagcagatttaccatgtacaagagatgattcaanaaagtacagtnaatcagacaatagaacagactagaagacgaacgaacgaacacgacacttaactaattataactaaaatagaaagtaacgtaggggaacgggggaaaacggtaaggggtacggacgggaaccgtacggtacgtccgtcgtcgtcgacgcccg

SEQ ID NO: 316806 - DNA, 538 bp, Homo sapiens
  misc_feature: GZ8MTXP02I7JKX.19.10.A10.1.454.CMB.2.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttnttgcctggtaccagcagagacctggccaggctcccaggctctgttanggtgccgtccaccgagggccacgtggcatcccccganaggttcaggtggcagtgtgtctggggacagtcttcactctcaccatcacgcaagactgggacgcctagactatttgactagttagtattactgtacaacgatatgatgactcaccgtacgtggtagactagttcggaccgaggggactaagggttagaagtacgaaacgtaacgtggtcgactgactaaccagtctcgtactctacttcttcccg

SEQ ID NO: 316807 - DNA, 540 bp, Homo sapiens
  misc_feature: GZ8MTXP02GENLH.19.10.A10.1.454.CMB.2.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctccaggcaccctgtctttgacccctggggaaanagccaccctctcctgcagggccgaataagagtgttgacagctaccttcttgccctggtaccagcagagacctggccaggcctcccaggctcctcgtttanggtncgtccaccgaggccactggccatccccganaggttcccagtcgcagtgtgtctggggacagtacttcgacttcncaccatcagcagactggacgctagaagtntttgctagtgtattactgacaacgtatatagatgacgtctaaccgtcgtggtcggtactaggttcggacgtacggggacctaaggttgaaagtaacgaaaacgaacgtagtcggtacacgtcaacg

SEQ ID NO: 316808 - DNA, 644 bp, Homo sapiens
  misc_feature: GZ8MTXP02GHIPY.19.10.A10.1.454.CMB.2.raw
  modified_base (331)..(331): a, c, t, g, unknown or other
  misc_feature (331)..(331): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggccccgggggtcctgagactctcctgtagaagttatggattcaacttcgctaggcggctggctgtgctgggtcgcaggctccgagggagggctggaggtgggtggccgnatcgaaggaggagagtagtagggaagggggaggacgaacaggacctaccgcctgccgacccggtgacggaggcaagtactttaccatgtacaagagatgaattacaaacaaagtacagtagtatcgtagactaaatcgaaacacgacctaaggaaacgaccggaaggaaccaacgacgtactaagtttactattaacgtaaacaaaagtagtaaagtacgggtaagggggaaacgggggtaaaacgtcgggggaaccgtaacggggtaacccgttacggtccgttaccggtactccgtaccgaccgtaccccg

SEQ ID NO: 316809 - DNA, 560 bp, Homo sapiens
  misc_feature: GZ8MTXP02H7Q4C.19.10.A10.1.454.CMB.2.raw
  modified_base (412)..(412): a, c, t, g, unknown or other
  misc_feature (412)..(412): n is a, c, g, or t
  modified_base (551)..(551): a, c, t, g, unknown or other
  misc_feature (551)..(551): n is a, c, g, or t
  modified_base (553)..(560): a, c, t, g, unknown or other
  misc_feature (553)..(560): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatgaaggggaggcgacagactacgctgcaccgtgagaggcagatttaccatgtcaagagatgattcaacaaagtacagtgtatctgcaaatgaaacagcctagaagaccgaggacacagccaatttactattgtaacaaaatgaaatacgtaggggaacgggggaaaattggggaccaggggaaccctggtccctccgtctcgtcacgcctccaccgaacgggcccacgttccggtccttccccccgngggcccgcccctgcctccaggacgccaccgtccgagacgcacgacgccggcccgtgggctcgccgtggtacgaacggacctaccgttcccgaacgtagacgtacgtggacgcgggactcggacgaacggcgactagagngnnnnnnnn

SEQ ID NO: 316810 - DNA, 634 bp, Homo sapiens
  misc_feature: GZ8MTXP02F5T87.19.10.A10.1.454.CMB.2.raw
  modified_base (407)..(407): a, c, t, g, unknown or other
  misc_feature (407)..(407): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggccccggggggtccctgagactctcctgtagaagttatggattcaacttcgctagcggctggctgtgctgggttcgccaggctccgagggagggctggagtgggttgccgcatcgaagaggagatagtggaaggggagcgacagactaccgctgcaccgtgagaggcagtattaccatgtacaaaganatagattacaacgtaaagtcagtagtatctagacaaatgaaacagaccgtagaaacgaccggaagacctacgacgtaccctaatttaccgtaatttacgtaaaactaaaacgtagtaaagttaccggggtaaggggggaaaccgggggtaaaagttcgggggacccgtaaagggggtaaccccgttcgggtccttacccggttctaccggtaccgacggtacccccg

SEQ ID NO: 316811 - DNA, 596 bp, Homo sapiens
  misc_feature: GZ8MTXP02IQZ18.19.10.A10.1.454.CMB.2.raw
  modified_base (412)..(412): a, c, t, g, unknown or other
  misc_feature (412)..(412): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggtcgccaggctccgaggggaaggggctgggagtggggttggccgcatcaaggaggagatagtggaaggggaggcgacgagactacgctgcacccgtgagaggcagatttaccatgtacaaganatgattcaacaaagtacagtgtaatctagacaaatgaaacagcctagaacgaccggaagaccacgagcctaatttactattacgaacaaaattgaaagtacggtaagggggaaacgggggtaaaacgttcgggggacctaaagggggaaccccttgggtcctaccgtcgtcggtcacggtcccc

SEQ ID NO: 316812 - DNA, 627 bp, Homo sapiens
  misc_feature: GZ8MTXP02GPGNN.19.10.A10.1.454.CMB.2.raw
  modified_base (331)..(331): a, c, t, g, unknown or other
  misc_feature (331)..(331): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctgggtggagtcgtgggggaggcgtggtccaggcccggggggtccctgagactctcctgtagaagttatggattcaacttcgctagcggctggctgtgctgggttcgccaggctccgaggagggctggagtgggtgccgnatcaagagagatatggaaggggaggcgacgagactaccgctgcacccgtgagaggcagtactttaccgatgtacaaagagatgaattacaaacaaaagtactagtagtaatctagacaaatgaaacagtccaagaaagaccggaagaaccaacacgacctaatttactaattagtaaactaaaagtagaaaagtacgggtaagggggaaacgggggtaaaagttacggggggaacctaacgggggaacccgttacgggtccgttacccggtgtaccggtaccgaacggtacccccg

SEQ ID NO: 316813 - DNA, 605 bp, Homo sapiens
  misc_feature: GZ8MTXP02GR2CD.19.10.A10.1.454.CMB.2.raw
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (400)..(400): a, c, t, g, unknown or other
  misc_feature (400)..(400): n is a, c, g, or t
  modified_base (445)..(445): a, c, t, g, unknown or other
  misc_feature (445)..(445): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtcctgagactctcctgtagaagttatggattcaacttcgctagcggctggctgtgctgggttcncaggctccagggagggctggagtgggtgccgcatcaagngganatagtggaaggggagcgacagactaccgctgcaccgtgagaggcagatttaccatgacaaagngatgattcaacaaaagtacagtgtaatctagactaaaatgaaacngacccttaggaaacgaccggaaggaaccaacgacgaccctaatttacatttacgtaaactaaaatagaaattaaccgggtagggggaaacgggggtaaaaattcgggggaccaaacggggaaccccttgggtacctcggtactcggtaccacggtacccc

SEQ ID NO: 316814 - DNA, 602 bp, Homo sapiens
  misc_feature: GZ8MTXP02HZW1R.19.10.A10.1.454.CMB.2.raw
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggttcgccaggctccgagggagggctggagtgggtggccgcagtcaagaggagatagtggaaggggaggcganagactacgctgcacccgtgagaggcagtatttaccatgtacaaagagatgattnaaactaaagtactagtgtatctagacaaagtacgaacacgtctaagaacgaaccggacggaacctaacgacgtacctaattttactaagttagtaacaaaatagtaaagtaacgtaggggggaacggggtaaaacgttcggggaccgaacggaaccgtaggtctccggactcgaccacgtacccg

SEQ ID NO: 316815 - DNA, 538 bp, Homo sapiens
  misc_feature: GZ8MTXP02GGOF5.19.10.A10.1.454.CMB.2.raw
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
  modified_base (499)..(499): a, c, t, g, unknown or other
  misc_feature (499)..(499): n is a, c, g, or t
  modified_base (530)..(538): a, c, t, g, unknown or other
  misc_feature (530)..(538): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctagaagaccgaggacacagccatttactattgacaaaatgaatacgtaggggaacgggggaaaattggggaccagggaaccctggtcctccgtctcgtcagccctcaccgaacgggcccatccggtccttcccccgtggcccnccctgcctccgaggacgccacctccgagacgcaacngtccggccctggggcctgcctgggtaccaaaggcctacgtccccaaggagagtacncggaggcgggctggacaacggcgacgatagnnnnnnnnn

SEQ ID NO: 316816 - DNA, 528 bp, Homo sapiens
  misc_feature: GZ8MTXP02IHWYL.19.10.A10.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagctaccttcttgcctggtaccagcagacgactggccaggctcccaggctctcgtttanggtgcgtccaccgngggccacgtggccactccccgagtaggtttccaggtggcaggtgtgtcgtggacagtacttcactcncacatcagcagcgtgacgctagatatttgntagtntatntgtacaagatanagtatgagtccacgttcgngtgactagttcggacgaggggacaaggttacgaagtacaaacgagtcggagtactgacaacgtatcgtgtacttcgacttcctcccg

SEQ ID NO: 316817 - DNA, 690 bp, Homo sapiens
  misc_feature: GZ8MTXP02JHF94.19.10.A10.1.454.CMB.2.raw
  modified_base (453)..(453): a, c, t, g, unknown or other
  misc_feature (453)..(453): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcgccaggctccgagggagggctggagtgggtgccgcatcaagagagatagtggaaggggagcgacagactacgctgcaccgtgagaggcagtactttaccatgtacaaagagatgattacaaactaaagtacagttgtaatcgtagaactaaaagtgaaaccnggtaccctaggaaacgacccggaaggaacccacgacggtacccttaaagttttaacctaagtttaacgtaaaacctaaaagttacggtaaacgttaacccgggggtaaagggggggtaaaacccgggggtaaaaagtttccggggggaaccccgttaaaacgggggtaaacccccgttgggggttaccccttacccgggttccgttacccggttaaccgaaccgggttacccccccg

SEQ ID NO: 316818 - DNA, 594 bp, Homo sapiens
  misc_feature: GZ8MTXP02I4BZG.19.10.A10.1.454.CMB.2.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggagggctggagtgggttgccgnatcaagnggagatagtggaaggggagcgacagactacgctgcaccgtgagaggcagtattaccatgtacaaagagatgattacaaacgaaagtacagtcgtaatctagacaaatagaaacngacctagaaacgacgagaccanacgacctaatttacgtatagtaaacaaaagtgtaaacgtacgggtagggggaaacgggggtaaaagtcgggggaccaacggggtaaccctgggtaccgtccgtctaccgtcacgtacccg

SEQ ID NO: 316819 - DNA, 591 bp, Homo sapiens
  misc_feature: GZ8MTXP02H4CSQ.19.10.A10.1.454.CMB.2.raw
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggagcgtggtccaggcccggggggtccctgagactctcctgtagaagttatggattcaacttcgctagcggctggctgtgctgggttcgccaggctccagggaaggggctggagtgggtgcgcatcaagngagatatggaaggggngcganagactaccgctgcaccgtgacgagcagatttaccatgtacaaagagatgattacaacaaagtacagtgtaatctgacaaatgaaacagccctagaaagaccgaggacacagacctaatttacattagaaactaaaatagaaagttacggtaagggggaaccgggggaaaaagtttccgggggaacaaacgggggaacccttgggtaccttacccggtctccggttaccacgccccg

SEQ ID NO: 316820 - DNA, 670 bp, Homo sapiens
  misc_feature: GZ8MTXP02HG3VI.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtgggtcgccaggctccgagggagggctggagtgggttggccgcatcgaaggaggagatagtggaaggggagcgacagactacgctgcaccgtgagagcagtactttacatgtacaaagagatgtattacaacaaaagtacagtagtatacgtagacaaaagtagaaacaggacccttaggaaaacgacccgaaagggaacctaacgaacggtaccctaaattttaacctaagtttacgtaaaactaaaagtacgtaaaagttaaaccggtaggggggtaaaaccggggggtaaaaagttaccgggggaacccgtaaacgggggtaaaaccccgtcggggttaccgttaccccggtcgttaccggttacccgacggtacccccg

SEQ ID NO: 316821 - DNA, 552 bp, Homo sapiens
  misc_feature: GZ8MTXP02GOLBQ.19.10.A10.1.454.CMB.2.raw
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (542)..(542): a, c, t, g, unknown or other
  misc_feature (542)..(542): n is a, c, g, or t
  modified_base (545)..(552): a, c, t, g, unknown or other
  misc_feature (545)..(552): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaaacagcctagaagaccgaggacacagcctatttactattagtaacaaaatgaaatacggtagggggaaacggggaaaattggggaccaaggggaaccctgggtcccctccgtctcgtcacgccctaccaccgaacgggcccagtccggtcccttcccccgnggcccnccctgcctccgaggacnccaccncgagcncacgcgccgccgtggctcgccgtggacaacggtcctacctcccgaagagagtacgnggacggcgggacncggacgacggcacagnggnnnnnnnn

SEQ ID NO: 316822 - DNA, 575 bp, Homo sapiens
  misc_feature: GZ8MTXP02HAQGZ.19.10.A10.1.454.CMB.2.raw
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(571): a, c, t, g, unknown or other
  misc_feature (569)..(571): n is a, c, g, or t
  modified_base (573)..(575): a, c, t, g, unknown or other
  misc_feature (573)..(575): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggtgccgcatcaagagagatatgaaggggagcgacagactacgctgcacccgtgagaggcagatttaccatgtcaagagatgattcacaaagtacagtgtatctgacaaatgaacagcctagaagaccgagacacagccatttactattgtaacaaatgaaatacgtgggggaacgggggaaaattcggggaccaggggaacccctgggtaccctccgtactcgtcacggccctaccgaccgaaacggggcccaagtcccgggttccttccccccggnggcccnccctgcctccgaggacnccaccgtccgagcgaccacgacggccgcccgtggctcgccgtaggtaccaacggtacctaccgtaccgaacgtagacgtacgaggacggcgggacgtacgggacgaaacggcacgtaagtagngncnnncnnn

SEQ ID NO: 316823 - DNA, 716 bp, Homo sapiens
  misc_feature: GZ8MTXP02G4UO4.19.10.A10.1.454.CMB.2.raw
  modified_base (383)..(383): a, c, t, g, unknown or other
  misc_feature (383)..(383): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgaccccgtggggaaagagcccaccctctcctgcagggccataagagtgttgacagctacttcttgcctggtaccagcagagacctggccaggcctcccgaggtcctcccgttcgtttagtcggtcgccgtacccaccgacgggcccacgtcggaccaccgtcccccggagtacggtttccaggttggcctaggtggtggtccgnggggacacggtaccttccacttcctaccacctatccgagccgaagtacgtgggaacgtacccgttaggaaacgtttagttttcggacgttaggtttacgttaacgtttacgtacgtttaaccgaaacgtattaagttagtaagttaggtaaccgttacccgtaccggttaccgggttagggttaacggtacgttaggtttccggggaccggtaacgggggtaaccgttaaaggggtttacggaaacggttaacgaaaacggtacgtacgggttacggacgtacgtaccaacgttacgttccgttacgttcttacgtcctttaccgttcccccg

SEQ ID NO: 316824 - DNA, 620 bp, Homo sapiens
  misc_feature: GZ8MTXP02JXFG9.19.10.A10.1.454.CMB.2.raw
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgcgtggtcgcaggctccgagggagggctggagtgggtgccgnatcaagaggagatagtggaaggggaggcgacagactacgctgcaccgtgagaggcagattaccatgtacaagagatgattacaaanaaagtacagtagtatctagacaaatagaaacagacctagaaacgaccgaagaccaacgacgacctaatttactattagtaaacaaaagtacgaaagtacggaaggggggtaaacgggggtaaaacgttacgggggacccgaacgggggtaaaccccgttggggtacccgttacccggttacctaccggttaccacggtacccccg

SEQ ID NO: 316825 - DNA, 632 bp, Homo sapiens
  misc_feature: GZ8MTXP02I3F8E.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcccgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctgggttcgccaggctccgaggggaaggggctgggaggtggggttggccgcatcgaaaggaggagatagtggaaggggagcgacagactacgctgccaccgtgagaggcagtatttaccagttgtacaaaggagatagattacaacaaaagtacagttagtatctagacaaaatgaaacagacctagaacgacccggaggaaccacgagcctaatttaactattagtaacaaaatagaaacgttacggtaggggggaaacgggggtaaaagttcgggggaaccgtaagggggtaaccccgtggggtcccgttcccggttctccggtaccacggcccttaaccccgg

SEQ ID NO: 316826 - DNA, 570 bp, Homo sapiens
  misc_feature: GZ8MTXP02ISAMZ.19.10.A10.1.454.CMB.2.raw
  modified_base (330)..(330): a, c, t, g, unknown or other
  misc_feature (330)..(330): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgaccccctggggaaagagccaccctctcctgcagggccgataagagtgttgacagctaccttcttgcctggtaccagcagagacctggccaggctcccaggctcctcgtttatggtgccgtccaccgagggcccacgtggccactccccganacggttcagtggcagtgtgtctcgggacagaccttcacttctccaccatccagcagactgggancctgaagtntttgctagtgttattacgtgtacaacgtatagtagatagtagtcctaccgtccggtggtcgactagttcggccgagggggaccaagggttacgaagtacgaaacggtaacgtggtacgactacgactaacctagtccgtacgttcttactacgttacctttaccccg

SEQ ID NO: 316827 - DNA, 678 bp, Homo sapiens
  misc_feature: GZ8MTXP02HVYME.19.10.A10.1.454.CMB.2.raw
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtggggaggcgtggtccaggcccgggggtcctgagactctcctgtagaagttatggattcaacttcgctagcggctggctgtgcgtggtcgcaggctcgagggaggctggagtggtgcgnatcgaagagagatagtaggaaggggagcganagactacgctgcaccgtgagagcagtaactttaccatgtacaaagtagatagaattacaaacgtaaaagtacagttacgttaatcgtagaactaaaagtcgaaaacctagacccgtaaggaaacggaacccggaaggaacccaacgaacgtacccttaaattttaacctaagtttaacgtaaaactaaaagttaggtaaaacgttaacggggtaagggggggtaaaaccgggggtaaaagttccgggggaacccgtaaagggggtaaacccccgttgggttaccccgttcccggtacgtttcccggtaccgtaccggtacccccg

SEQ ID NO: 316828 - DNA, 625 bp, Homo sapiens
  misc_feature: GZ8MTXP02HAZAE.19.10.A10.1.454.CMB.2.raw
  modified_base (325)..(325): a, c, t, g, unknown or other
  misc_feature (325)..(325): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtggggaggcgtggtccaggcccggggggtccctgagactctcctgtagaagttatggattcaacttcgctagcggctggctgtgctggtcgcaggctccgagggagggctggagtgggtgccgnatcaagaggagatagtggaaggggagcgacagactaccgctgccaccgtgagagcagtatttaccatgtacaaagagtatgaattacaaactaaaagtactaaggttataacttcgtagaactaaaagtacggaaaccagcccgtaaggaaacgacccggaaaggaccaacgagaccctaaagtttactagtttaacgaactaaaatcgaaagtacggtaaggggggaaacggggtaaaagtcgggggaccaaacggggtaacccgtggtcccgtaccggtctaccggtacacgtccccc

SEQ ID NO: 316829 - DNA, 529 bp, Homo sapiens
  misc_feature: GZ8MTXP02HPS2H.19.10.A10.1.454.CMB.2.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagngccaccctctcctgcagggccataagagtgttgacagcaccttcttgcctggtaccagcagagacctggccaggctcccaggctcctcgttanggtgcgtccacagggccactggccactccccganaggttcagtgcagtgtgtctgggacagcttcactctcnccatcagcagctggacgcctagaagtatttgctagttgtattactgtacacgtatatgaatgtatcaccgtccgtggtgactagttcggaccgtaggggactaagggttagaaagttacgaaaacgacgtagtcgctgacaaccgtatctcgtcttcacttccgttcccg

SEQ ID NO: 316830 - DNA, 594 bp, Homo sapiens
  misc_feature: GZ8MTXP02F6J7A.19.10.A10.1.454.CMB.2.raw
  modified_base (265)..(265): a, c, t, g, unknown or other
  misc_feature (265)..(265): n is a, c, g, or t
  modified_base (333)..(333): a, c, t, g, unknown or other
  misc_feature (333)..(333): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggcccgggggtccctgagactctcctgtagaagttatggaccttnaacttcgctagcggctggctgtgctgggttcgccaggctccgagggaagggctggagtgggtggccgnatcaagaggagatagtggaaggggagcgacagactacgctgcaccgtgagaggcagattaccatgtacaagagatgaattacaacaaagtcagtgtatctgacaaatgaaacagtcccgagaaacgaccggaaggaaccactacggacctaatttacaagtttagtaaacaaaattgaaatacggtagggggaaacgggggtaaaattcgggggacctaaaggggaacccgtggtaccgtccggtctcgtacgcgaccccg

SEQ ID NO: 316831 - DNA, 646 bp, Homo sapiens
  misc_feature: GZ8MTXP02GSD9C.19.10.A10.1.454.CMB.2.raw
  modified_base (193)..(193): a, c, t, g, unknown or other
  misc_feature (193)..(193): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaangccaccctctcctgcagggccgataagagtgttgacagctaccttcttgcctggtaccagcagagacctggccaggcctcccgaggcctccgtcgtttatggtgccgtcccaccgngggccactggcactccccgancggttcaggtggctagtgtgtcgtggggacagacttcacttcctacnccatcgagcacgtactagggacnccgtagtaaagttatttggctaaggttgttaacttacgtacgtaccaaaggtatagtaggtatggtacgtaccgtacccgttccggttacgggtacggtacgtacggtttacggggaccgtaaacgggggtaacccgtaaggggtttaagaaacggttaaaccgtaaaacggttaccgtaaggttcggacggtacgtacgtaaccctaacgttcttacggttccttacctaccgtttcccttcccg

SEQ ID NO: 316832 - DNA, 604 bp, Homo sapiens
  misc_feature: GZ8MTXP02IHADN.19.10.A10.1.454.CMB.2.raw
  modified_base (327)..(327): a, c, t, g, unknown or other
  misc_feature (327)..(327): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctgggtcgcaggctccgagggagggctggagtgggtggccgnatcaagaggagatagtggaaggggaggcgacagactaccgctgcacccgtgagaggcagatttaccatgtcaaagagatgattacaacaaaagtacagtgtatctagacaaatgaaacagacctagaacgaccggaagacaacacgacctaatttaactattagtaaactaaaatagaaagttaacggtaaggggggaaacgggggtaaaagttacgggggaaccgaagggggtaaacccgtgggtaccctccggtacgtccgtacgacgtaccccg

SEQ ID NO: 316833 - DNA, 595 bp, Homo sapiens
  misc_feature: GZ8MTXP02GR43E.19.10.A10.1.454.CMB.2.raw
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgcaaatgaaacagcctagaagaccgaggacacagcctatttactattgtaacaaatgaatacgtaggggaacggggtaaaattggggaccaagggaccctggtccctccgtctcgtcagccctccaccgaagggcccagtccggtccttcccccgtgggccnccccgtgcctacccgaggcncacccgtccgagcgcacgacgccgcccgtggggcctcgccttcgggtaccaaacggtaccttaccgtttacccccgaacggtaacggaaacgtgggaacggtccgggggtactggggaccaaacggggccgaaccgaagttaaggngngcgacgcancncnn

SEQ ID NO: 316834 - DNA, 675 bp, Homo sapiens
  misc_feature: GZ8MTXP02G2Y04.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctgagactctcctgtagaagttatggattcaacttcgctaggcggctggctgtgcgtgggttcgccgaggcctccgaggggaaggggcgtgggaggtggggttcggccgcaagtcgaaaggaggagaatagtagggaaaggggaggacgacgagactaccgctgccaccgtgagagcagtattaccatgtacaaagagatgaacttacaaactaaaagtacagttagtaactctagaacaaagtagaacacgacctaagaaacgaccgaagaacacgtacgtacctaagtttactaagttacgaaaactaaaatacggaaaaccgttaggggtaacggggggaaaacgggggtaaaacgttcgggggaacccgtaaaacgggggtaaccccgttcgggttaacccgtcccggttaccgtaccgtccgaaccggttcccccg

SEQ ID NO: 316835 - DNA, 646 bp, Homo sapiens
  misc_feature: GZ8MTXP02JKJXR.19.10.A10.1.454.CMB.2.raw
  modified_base (381)..(381): a, c, t, g, unknown or other
  misc_feature (381)..(381): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctgagactctcctgtagaagttatggattcaacttcgctagcggctggctgtgcgtggtcgcaggctcgagggagggctggagtgggtgccgcatcgaagaggagatagtaggaaggggagcgacgagactacgctgccaccgtgagngcagtacttaccatgtacgaaagagtatgaattacgaaacgtaaagtacaagttgtaatctagactaaatagaaacagacccgtaggaaacgaccggaagaaccgaacgacgtaccttaatttactaatttaacgaaataaaagtacggtaaagtaacgggtaagggggggtaaacggggtaaaacgggttcgggggacccaaacgggggtaaccccgttgggtacccgttacccggtccgtccggtaccgtaccggtaaccccg

SEQ ID NO: 316836 - DNA, 581 bp, Homo sapiens
  misc_feature: GZ8MTXP02G7YBJ.19.10.A10.1.454.CMB.2.raw
  modified_base (207)..(207): a, c, t, g, unknown or other
  misc_feature (207)..(207): n is a, c, g, or t
tcagtactctcgtgcacgaccggtgctcgatttagcgtcgatctcaggggcagagctctggagaagagctgctaagttaggacccagagggaaccatggaaaccccagcgcagcttctcttcctcctgctactctggctcccagatagcaccggagaaattttctgacgcagtctccaggcaccctgtcttgacccctggggaaagngccaccctctcctgcagggccgataagagtgtgacagctaccttcttgcctggtaccagcagagacctggccaggcctcccgaggtcctccgttcgtttagtggtcgccgtaccaccgagggcccacgtcggcacgtccccgataggttcacggtggctagtgtgtctggggacagtacttcactctacaccatcagcagacgtggacgtaccgtgaagtagtttgactagttagttacttacgtgtacaacgtatatgatgacgtcaccgttcggtgtcggtactacggtttacgggaccgtagggggtaaccgtaagggttacgaaacgttacgaaaacgtacgtacggtcggtacgtacggaccacgtacg

SEQ ID NO: 316837 - DNA, 601 bp, Homo sapiens
  misc_feature: GZ8MTXP02GINP8.19.10.A10.1.454.CMB.2.raw
  modified_base (402)..(402): a, c, t, g, unknown or other
  misc_feature (402)..(402): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgagggaaggggctggagtgggtggccgcatcaagaggagatagtggaaggggaggcgagagactaccgctgcaccgtgagaggcagattacatgtacaganatgattcaacaaagtacagtgtatctagacaaatgaaacagtcctaggaaacgacccggaaggaaccacgagacctaatttacctagttagtaaacaaaatgaaatacgggtaggggggaaacgggggtaaaagttcgggggacccgaaagggggaacccgttgggtccgttccggtaccttcggtaccgacgtccccg

SEQ ID NO: 316838 - DNA, 674 bp, Homo sapiens
  misc_feature: GZ8MTXP02GB2FJ.19.10.A10.1.454.CMB.2.raw
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (401)..(401): a, c, t, g, unknown or other
  misc_feature (401)..(401): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggtcnccaggctccgagggagggctggagtgggtgcgcatcaagngagatanggaggggagnganagactacgctgcaccgtgagaggcagtatttaccatgtacaaaganatgattacaaacaaagtacagtagtatctgacaaatacgaaacaggcctaagggaaacgacccggaaggaaccaacgacgtacccttaaatttaacctaatttacggtaaaacaaaagttaggaaaaacgttaacgggtaaacggggggggtaaaaccgggggggtaaaaaagtttcgggggggaaacccgtaaaaccggggggtaaccccgttacgggggttaaccccgttcccggggttaccgtttccggtaccgtaacggtaaccccccg

SEQ ID NO: 316839 - DNA, 567 bp, Homo sapiens
  misc_feature: GZ8MTXP02FS4KY.19.10.A10.1.454.CMB.2.raw
  modified_base (361)..(361): a, c, t, g, unknown or other
  misc_feature (361)..(361): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccgagggaaggggctggagtgggttggccgcatcaagaggagatagtggaaggggagcganagactaccgctgcacccgtgagagggcagactttaccatgtacaaagagatgattacaacaaagtacagtgtatctgacaaatgaacagctagaagaccgagacacgagcctattactattagaacaaatgaaatacgagggggaacgggggaaaagttcggggaccgaagggaacccgtgggtacctccgtctcgtcacgtcccc

SEQ ID NO: 316840 - DNA, 633 bp, Homo sapiens
  misc_feature: GZ8MTXP02HBV0R.19.10.A10.1.454.CMB.2.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgctggtcnccaggctcgagggagggctggagtgggtgccgcatcgaagaggagatagtggaaggggngacganagactaccgctgccaccgtgagagcagtactttaccgatcgtacgaaagagtatgtaaacttcgaaacgtaaaagtacgaaggttaggtaaattccgtaggaacaaaagttacggaaacctaggccctaaggaaacggacccggaaggacacacgacctaatttaactaagttacgtaaactaaatagtaaacgtacgggtaagggggaaacggggtaaagttacggggaccgtaacgggaaccgtcggactaccgtcgcgtacaccgtacccg

SEQ ID NO: 316841 - DNA, 586 bp, Homo sapiens
  misc_feature: GZ8MTXP02GBSHF.19.10.A10.1.454.CMB.2.raw
  modified_base (460)..(460): a, c, t, g, unknown or other
  misc_feature (460)..(460): n is a, c, g, or t
  modified_base (545)..(545): a, c, t, g, unknown or other
  misc_feature (545)..(545): n is a, c, g, or t
  modified_base (556)..(556): a, c, t, g, unknown or other
  misc_feature (556)..(556): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(586): a, c, t, g, unknown or other
  misc_feature (579)..(586): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaacgaccgagacacagcctatttactattgtaacaaatgaaatacggtaggggggaaacgggggtaaaagttcggggaccgaaggggaacccctggtcccctcccgtctcgtccacgtccctaccgaccgaacgggccccagttcccgggttcccttcccccgtgggccctccctgccctccgagggacncccacccgtccggagacgcacgacggccggcccgtgggcctgcccgttgggacaacggtccttacctcccgaagaggacgtacgnggacggcgggntcgggacgacggcgacagngngnnnnnnnn

SEQ ID NO: 316842 - DNA, 631 bp, Homo sapiens
  misc_feature: GZ8MTXP02JZJSV.19.10.A10.1.454.CMB.2.raw
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (620)..(620): a, c, t, g, unknown or other
  misc_feature (620)..(620): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctaattttaaaaggtgtcctgtgtgaggtgcgcctggtggagtcgtgggggaggcgtggtccgaggccccgggggtccctgagactctcctgtagaagttatggattcaacttcgctagcggctggctgtgcgtgggtcgccaggctccgagggagggctggagtgggtgccgnatcaagagganatagtggaaggggagcganagacacgctgcaccgngagacgcagtacttaccagtgtacaaagagtatacgtaattacaaactaaaagtacagtagtactcgtagacaaatagaaactgaccgtagaaaccgacggaagaacaccgagacccttaatttccgtaattacgaaactaaaagtacggaaacgttacggggaaaggggggaaaccggggtaaaagtccgggggaaccgtaaaccgggtaaccgtcggtaccgtcccggtactccggtacnccgtacccccg

SEQ ID NO: 316843 - DNA, 601 bp, Homo sapiens
  misc_feature: GZ8MTXP02HBO59.19.10.A10.1.454.CMB.2.raw
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttccttctgctattttaaaaggtgtcctgtgtgaggtgcgcctggtggagtcgtgggggaggcgtggtccaggcccgggggtcctgagactctcctgtagaagttatggattcaacttcgctagcggctggctgtgcgtgggtcgccaggctccgaggggagggctggagtgggtgccgnatcaagagganatagtggaaggggnggacgacgagactacgctgccaccggngagngcagtattaccatgtacaaaganatgtattacaacaaaagtcagtcgtatctagacaaaagtgaaacacgcctaaggaaacgaccggaagaccaacgacgtacctaatttactaatagtaaactaaaagtgaaagtacgggtagggggaaacgggggtaaagtcgggggaccgtaacggggaaccgttgggtaccctcgtacgtcgtacgacgtccc

SEQ ID NO: 316844 - DNA, 637 bp, Homo sapiens
  misc_feature: GZ8MTXP02IHW0H.19.10.A10.1.454.CMB.2.raw
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
  modified_base (450)..(450): a, c, t, g, unknown or other
  misc_feature (450)..(450): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttccttctgctattttaaaaggtgtcctgtgtgaggtgcgcctggtggagtctgggggagcgtggtccaggcccgggggtcctgagactctcctgtagaagttatggattcaacttcgctagcgctggctgtgctgggttcgccaggctccaggggaggggctggagtggggttggccgnatcaagaggagatagtggaaggggnggcgacagactaccgctgcacccgtgagaggcagatttaccatgtcaaagagatgattcaacaaaagtacagttacgtatctagacaaagtgaaaccngaccctagaaacgaccggtaaggacctaacgacgtacctaaattttacctaatttacgtaaactaaaagttgaaaactaccgggttaaggggggaaaaccggggggtaaaatttacggggggaccaaacgggggtaaacccgttcgggtaccgttacccgtacgttcccggtacgtacggacccccg

SEQ ID NO: 316845 - DNA, 660 bp, Homo sapiens
  misc_feature: GZ8MTXP02I6PFO.19.10.A10.1.454.CMB.2.raw
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctggggaggcgtggtccagcccgggggtccctgagactctcctgtagaagttatggattcaacttcgctagcggctggctgtgctggttcgccaggctccgagggaagggctggagtgggttgccgnatcaaagaggagatagtggaaggggagcgacagactacgctgcacccgtgacgngcaggatttaccatgtcaaagngaatgaattcaactaaaagtacaagtgtaatctagacaaatagaacaagacgtagaacgaccgaacgaacgacgacgaccgtaactttaaccttaattagttaacctaaaacgtaaacggtaaagttaaaccgggtaagggggtaaaccggggggtaaaaggggtttaacgggggtacccggaaaccggggtaaacccggttaaccgggttaccggttaccccggttaccgtccggtttaccggaccgtaacccccgg

SEQ ID NO: 316846 - DNA, 664 bp, Homo sapiens
  misc_feature: GZ8MTXP02GSJEI.19.10.A10.1.454.CMB.2.raw
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcgtggtccaggcccgggggtcctgagactctcctgtagaagttatggattcaacttcgctagcggctggctgtgcgtggtcncaggctcgagggaggctggagtgggtgccgnagtcgaagaggagatagtaggaaggggagacgacagactaccgctcgcaccgtgacgaggcagtactttaccagtgtacgaaagagatcgaattacaaactaaagtacagttagtatctagaacaaagtagaaacacgtaccgtaaggaaacgaccggaagaaccaacgtacgacccttaatttaaccgtagttagtaaaactaaagacggtaaaggttaaccggggtaaggggggaaaaccgggggtaaaaacgttccggggggaaaccctaaacgggggtaaaccccgttcgggttaacccgttccccggtacgtccggtaccgtaaccgtacccccg

SEQ ID NO: 316847 - DNA, 544 bp, Homo sapiens
  misc_feature: GZ8MTXP02FIQ8D.19.10.A10.1.454.CMB.2.raw
  modified_base (355)..(355): a, c, t, g, unknown or other
  misc_feature (355)..(355): n is a, c, g, or t
  modified_base (487)..(487): a, c, t, g, unknown or other
  misc_feature (487)..(487): n is a, c, g, or t
tcagtactctcgtgcacgaccggtgctcgatttagcgtcgatctcagggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggagcgtggtccagcccgggggtccctgagactctcctgtagaagttatggattcaacttcgctagcggctggctgtgctgggttcgccaggctccagggaagggctggagtgggttggccgcatcaagaggagatatggaaggggagcganagactaccgctgcaccgtgagaggcagatttaccatgtcaaagagatgattcaacaaagtacatgtaatctgacaaatgaaacagcctagaagaccgaggaacacagccattacatgaacaaatgaatacgnggggaacgggggaaaattgggggactagggaacctggactaccgcgtcgtcagtccc

SEQ ID NO: 316848 - DNA, 611 bp, Homo sapiens
  misc_feature: GZ8MTXP02JJD4N.19.10.A10.1.454.CMB.2.raw
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtggggaggcgtggtccaggcccgggggtccctgagactctcctgtagaagttatggattcaacttcgctagcggctggctgtgcgtggtcncgagctccgagggaggctggagtgggttgcgnatcaagaganatagnggaaggggngcganagactaccgctgaccaccgtgagacggcagtaactttaccgatagtacaaagtagatgacttacaactaaagtcaagttgaattcgagaacaaagtagaaacagacctaggaaacgacgaaggactacgacgccttaaattactattagaactaaaatgtaaacgtacggggtaaagggggaaaccggggtaaaagtcgggggacccaaacggggtcccgtaggggtccctaccgggtctccggtaccaccgtacccc

SEQ ID NO: 316849 - DNA, 589 bp, Homo sapiens
  misc_feature: GZ8MTXP02GWJTP.19.10.A10.1.454.CMB.2.raw
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgagggaagggctggagtgggtgccgcagtcaagaggagatagtggaaggggagcgacagactacgctgcaccgtnagagcagacttaccatgtacaaganactgaattacgaanaaaagtcagtgtaatctagacaaatcgaaacngacctagaaacgacccgagaacctacagaccctaatttacagtttnaaaacaaagtgaaacgtacggtagggggaaacggggtaaaagttcggggaccaagggggtaaccctgggtacctccggtctcggccaacggccc

SEQ ID NO: 316850 - DNA, 747 bp, Homo sapiens
  misc_feature: GZ8MTXP02I6EDI.19.10.A10.1.454.CMB.2.raw
  modified_base (733)..(733): a, c, t, g, unknown or other
  misc_feature (733)..(733): n is a, c, g, or t
  modified_base (740)..(741): a, c, t, g, unknown or other
  misc_feature (740)..(741): n is a, c, g, or t
  modified_base (743)..(743): a, c, t, g, unknown or other
  misc_feature (743)..(743): n is a, c, g, or t
  modified_base (745)..(746): a, c, t, g, unknown or other
  misc_feature (745)..(746): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaacgaccgagacacagcctaatttactattagaacaaatgaaattacggtaggggggaaacggggtaaaagttcgggggaccaacggggtaaacccgttcgggtccccttacccggtcgttccggtacctacggtccccttacccacccggtaaacggggccccctaacggtcccgggtttacccctttccccccccgggcgggtccccgtccccgtcgaccccgtaccggaacgggtaccgacccctacccggtcccggaaaggacccgaccgaccggaccggggtccccgggtcccccggttcgggggacccttcgggtacccgttacgggggtaaacccgtaaaaccgggttacccctttaacccgttacccgggaaacggtaacggttaaccggtaccggtacggggaacggggtccggggtacgacggggaaaccggaaacgggccgaacgaagtcgngcgcgcnncncnng

SEQ ID NO: 316851 - DNA, 608 bp, Homo sapiens
  misc_feature: GZ8MTXP02GLOWZ.19.10.A10.1.454.CMB.2.raw
  modified_base (368)..(368): a, c, t, g, unknown or other
  misc_feature (368)..(368): n is a, c, g, or t
  modified_base (441)..(441): a, c, t, g, unknown or other
  misc_feature (441)..(441): n is a, c, g, or t
  modified_base (478)..(478): a, c, t, g, unknown or other
  misc_feature (478)..(478): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggcctccgaggggaaggggctgggagtggggttggccgcatcaagaggagatagtggaaggggagacganaggactaccgctgcacccggtgagaggcagtactttaccatgtacaagagatgaattcaaacaaagtacagtntatctgacaaatgaaacagcctagaacgacgagacanacgctaatttacagttagaactaaagtagaagtacgggtagggggaaacgggggttaaaagtcgggggaccaacgggggtaaacccgttcgggtaccgttccggtacgtccgttaccgacggtacccccg

SEQ ID NO: 316852 - DNA, 846 bp, Homo sapiens
  misc_feature: GZ8MTXP02HB0NF.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggcccgggggtcctgagactctcctgtagaagttatggattcaacttcgctagcggctggctgtgcgtgggttcgccgaggcctaccgaggggaacggggctagggaggttggggttcggccggcaagtccgaaaaggaggaagaatagtagggaaagggggaggacgaacgaaggaacctacccggactcgaccgaacccccggtaggaacggacgggcctaaaggtaacttttaacccgagttaggtaacaaagggtaagaaagttgtaaagtttaccaaaacgtaaaaagtaacgtaagttagtaacttacgtaggtacaaaaagttacgaaaacgaacggtacccgttaaagggaaaaccgggaaccggaacggaaaaccaccgtaaacggacccttaaagtttttaaacccgttaaatttaacggtaaaaccttaaaaaaggtttacggtaaaacgtttaaaaccgggggtaaaggggggggttaaaaacgggggggtaaaaacgtttaccgggggggaaccccgtaaaaacggggggtaacccccgtttacgggggttaaccccggttccccggtttaaccggttccccggtaacccgttaaacccgggtcccccccg

SEQ ID NO: 316853 - DNA, 567 bp, Homo sapiens
  misc_feature: GZ8MTXP02I3LA2.19.10.A10.1.454.CMB.2.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttctgacgcagtctccaggcaccctgtcttgaccctggggaaangccacctctcctgcagggccataagagtgttgacagcaccttcttgcctggtaccagcagagacctggccaggcctcccgaggctcctcgtttanggtgcgtccaccgaggggcccagtggccacgtcccccganaggttccagtggcaggtgtgtctggggacagtacttcgactctcaccatcagcagactggacgcctagagtattgctagtctaattactgtacaacgtatagtagagtagacgtcgtaaccgtccggtaggtacggacttagtttcgggaccggtaacggggaccgtaagggttacgaaagtaaccgtaaaacggtacgttaggtacggacgtacggaccgtaaccg

SEQ ID NO: 316854 - DNA, 707 bp, Homo sapiens
  misc_feature: GZ8MTXP02I8CG9.19.10.A10.1.454.CMB.2.raw
tcagtactctcgtgcacgaccggtgctcgatttagcgtcgatctcagggggagctgctcagttaggacccagagggaaccatggaaaccccagcgcagcttctcttcctcctgctactctgactcccagatagcaccggagaaattttcttgacgcagtctccaggcaccctgtctttgacccctggggaaagagcccaccctctcctgcagggccgataagagtgttgacagctaccttcttgcctggtaccagcagagacctggccaggcctcccgaggcctcctcgtttatggtgccgtcccacgacgggcccacgtcggccaccgtcccccggatacgggtttccaggtcggacctaggttggtggttcgtaggggaacctaggtacctttccgacctttccaccaccctatcccgaagcctaaggaccttggggacgtacccgtaggtaaacgttagttttcgacgtaggttagtttaacttacgtggtactaaacgtattaagttaggtatacggtacgtccgtaccggttccggttagggtacggtacgttacggtttcgggaccggtaacgggggtaacccgtaaggggtttacgaaaacggttaaccgaaaacggtaaacgttcgggtacggtaccgtacggacctaaccctagttccgtttacggtccgtttacctaccgtttacccgtttcccccg

SEQ ID NO: 316855 - DNA, 834 bp, Homo sapiens
  misc_feature: GZ8MTXP02F47YL.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggtcgtccgacggcgtccgacgggaaggggacggtggaggtggggttgggccggccgagtacgaagaaggagataagtaggaagggggagggacggaacgtaacggaacgtaacccggaccgtcgtaccgacccccggtacggaaggaacgggccggaagtaacgtttaaaccgtacgttagttacgaaagaaggtaaatggtaactttacgaaaacctaaaaagggttaactaggtagtttactaacgttcgggaaactaaaaattacggaaaaccgaggacccccgttaagggaaaaaccggaaccccgggggaaggaaaacccacaaaaccgggtcccccttttaaaagtttttaaaccttaagtttaaacgggttaaaaccctaaaaaaaagttacggtaaaaggttaaaacccgggggttagggggggggtaaaaccccggggggtaaaaaaaggtttccggggggaccccgtaaaacgggggtaaccccgttcggggttccgttaccccgtccgttaccggtacggaacccgttcccccg

SEQ ID NO: 316856 - DNA, 652 bp, Homo sapiens
  misc_feature: GZ8MTXP02HNXJM.19.10.A10.1.454.CMB.2.raw
  modified_base (609)..(609): a, c, t, g, unknown or other
  misc_feature (609)..(609): n is a, c, g, or t
  modified_base (620)..(620): a, c, t, g, unknown or other
  misc_feature (620)..(620): n is a, c, g, or t
  modified_base (642)..(642): a, c, t, g, unknown or other
  misc_feature (642)..(642): n is a, c, g, or t
  modified_base (644)..(652): a, c, t, g, unknown or other
  misc_feature (644)..(652): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctaggaaacgaccgaggaacacagaccctaattttaacgtattacgtaactaaaagtgaaaacgttacggtagggggggaaaccggggggtaaaaatttcggggggaccaacgggggtaaaccccgtggggtccccctacccggtcgttccgtccacgtcccccgttccaaccccggaaaccgggggtccccctacggttccccggggtttcccccttcccccccggtgggtcccccgtccccgttgccccgttaccgacgggacgccctaccgcccgagacgcacgagccggcccgtggcctgcctgggtaccaaggccctacgtcccgagagtcgtacgngacggcggggnacgggacgaacggcgcttaagngnnnnnnnnn

SEQ ID NO: 316857 - DNA, 591 bp, Homo sapiens
  misc_feature: GZ8MTXP02JGY05.19.10.A10.1.454.CMB.2.raw
  modified_base (390)..(390): a, c, t, g, unknown or other
  misc_feature (390)..(390): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgagggaggggctggagtggggttggccgcatcaagaggagatagtggaaggggaggcgacgagactaccgctgcacccgtgagagcagntttacatgtacaaagagatgattcaacaaagtacagtgtaatctgacaaatgaaacagcctagaaacgaccggaaggaacacgagccctaatttactattagtaacaaaataggaaattacggtagggggaaacgggggtaaaattcgggggaccgaaggggaacccgtgggtacctccggtactccggtcacgtaccccg

SEQ ID NO: 316858 - DNA, 612 bp, Homo sapiens
  misc_feature: GZ8MTXP02HTP4O.19.10.A10.1.454.CMB.2.raw
  modified_base (115)..(115): a, c, t, g, unknown or other
  misc_feature (115)..(115): n is a, c, g, or t
  modified_base (557)..(557): a, c, t, g, unknown or other
  misc_feature (557)..(557): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (604)..(612): a, c, t, g, unknown or other
  misc_feature (604)..(612): n is a, c, g, or t
tcagtactctcgtgcacgaccggtgctcgatttagcgtcgatctcaggggtccctgagactctcctgtagaagttatggattcaacttcgctagcggctggctgtgctgggttcnccaggctccaggggaaggggctggagtgggttggccgcatcaagaggagatatggaaggggaggcgacagactacgctgcaccgtgagaggcagatttaccatgtacaagagatgattacaacaaagtacagtgtatctgacaaatgaacagccagaaacgacgaggacacagcctaatttactattagtaacaaaatagaagtaacgggtaggggggaaacgggggtaaaagttcggggaaccgaacggggtaacccgtggtccccgttcccgtacgtccgtacacgcccctaccgaccgaacgggcccacgtccgtccctcccccgtgccctcccgtagccctcgaaggccacccacccgtcgacgacgccacgcggtcccggcccgtggggcctcgaccggttggaacctaaacggacccttaccgtacccgaaagganaaaccgtgggaaccggcgggtcagggaaccaagggttccncganagnnnnnnnnn

SEQ ID NO: 316859 - DNA, 569 bp, Homo sapiens
  misc_feature: GZ8MTXP02IZP8K.19.10.A10.1.454.CMB.2.raw
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccataagagtgttgacagcaccttcttgcctggtaccagcagagacctggccaggcctcccaggcctcctcgtttanggtgccgtccaccgagggccacgtggccactcccccganacggtttcaggttggctagtgtgtcgtggggaccagcttcactctcacctatcagtcagactgggacgcctagaagtatttgacagtgtattactgtacaacgtatatgatgagtcaccgtcgtggtggactagtttcggaccgtaggggaccgtaaggttacggaagttacgaaacggtaacgtggtcggtacgtggacctaaccgtatcgttcgttacttactactttccgttccccg

SEQ ID NO: 316860 - DNA, 642 bp, Homo sapiens
  misc_feature: GZ8MTXP02GJT9G.19.10.A10.1.454.CMB.2.raw
  modified_base (531)..(531): a, c, t, g, unknown or other
  misc_feature (531)..(531): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggcccgggggtccctgagactctcctgtagaagttatggattcaacttcgctagcggctggctgtgctggttcgccaggctccgaggggaagggctggaggtggggttcggccggcatcaaaggaggagatagtaggaaagggggaggacgacaaggacctaccggctcgaccaccccggtgaaggacggcagtaactttacccgaattcgtacaaaggataatgaactttacaaacgtaaaaggtactaaggtagttaatctagactaaaatacgaaacaagtacctagaaacgaaccgaaggaaccanacgacctatttactatagtaacaaagtagaaagtacggtagggggaaacggggtaaagtcggggaccgtaaggggaacccgttggtccgtacgtcgtccgacacgtacccg

SEQ ID NO: 316861 - DNA, 627 bp, Homo sapiens
  misc_feature: GZ8MTXP02JVMUS.19.10.A10.1.454.CMB.2.raw
  modified_base (193)..(193): a, c, t, g, unknown or other
  misc_feature (193)..(193): n is a, c, g, or t
  modified_base (326)..(326): a, c, t, g, unknown or other
  misc_feature (326)..(326): n is a, c, g, or t
  modified_base (441)..(441): a, c, t, g, unknown or other
  misc_feature (441)..(441): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgttgacagcaccttctttgcctggtaccagcagagacctggccaggcctccaggctcctcgttatggtcgcgtccaccgagggccacgtggcactccccgganacggtttcaggtggcaggtgtgtcgcggggacagacttcactcctcaccatcagcagacgtggagcctagaacgtatttggactagttagtacttacgtgttacgaactattaangtaattggacgtactacccgttccggtaggtacgggaccttaggtttacgggaccggttaacgggggaaaccctaaagggtttacggaaaacggttaccgaaaaaccggtaacgttagggtaacggcgttacggacctaaccgtaacgttctacggttaccttactaacgttccctttacccccgg

SEQ ID NO: 316862 - DNA, 566 bp, Homo sapiens
  misc_feature: GZ8MTXP02FXES5.19.10.A10.1.454.CMB.2.raw
  modified_base (293)..(293): a, c, t, g, unknown or other
  misc_feature (293)..(293): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcnccaggctccgagggagggctggagtgggtgccgcatcaagaggagatagtggaaggggagcgacagactaccgctgcacccgtgagaggcagatttaccatgtacaagagatgattcaacaaagtcagtgtaatctagacaaagtgaaacagacctagaacgaccgaggaccacagcctaatttacattgaacaaaatgaaagtacggtagggggaacggggtaaaattcggggaccgagggaacccgtggtactccgtctcgtcacgtcccg

SEQ ID NO: 316863 - DNA, 654 bp, Homo sapiens
  misc_feature: GZ8MTXP02JCZXW.19.10.A10.1.454.CMB.2.raw
  modified_base (360)..(360): a, c, t, g, unknown or other
  misc_feature (360)..(360): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcgccaggctccgagggagggctggagtgggttggccgcatcaagaggagatagtggaaggggaggcganaaggactaccgctgccacccggtgagaggcagtactttaccatgtacaagacgatagattacaaacgtaaaagtacgaagttacgtaattcgtagactaaaagttgaaaacaggacccttaggaaacgaccggaagaaccaacgacgtacctaatttaacctagtagtaaacctaaagtacggaaagtacgggtaacgggggaaacgggggtaaaacgttacgggggaaccgaacgggggtaaccccgtagggttacccgttaccggtaccgtaccgtccgtacggtacccccg

SEQ ID NO: 316864 - DNA, 634 bp, Homo sapiens
  misc_feature: GZ8MTXP02HWQ85.19.10.A10.1.454.CMB.2.raw
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttccttctgctattttaaaaggtgtcctgtgtgaggtgcgcctggtggagtctgggggaggcgtggtccagcccggggggtccctgagactctcctgtagaagttatggattcaacttcgctagcggctggctgtgctgggtcgccaggctccgagggagggctggagtgggtggccgnatcaagaggagatagtggaaggggaggcgacagactaccgctgcaccgtgacgaggcagactttaccatcgtacaaaganatagattacaacaaaagtacagtgtatacgtagacaaaatgaacagaccctagaaacgaccggaaggaacacgagtacctaatttactattacgtaaactaaaatgtaaaagtaaccgggtaagggggaaaccggggggtaaaagttcgggggaacccgtaacgggggaaaaccccgttggggtacccgtttcccgggtactttacccggttacgaaccggtcccccg

SEQ ID NO: 316865 - DNA, 668 bp, Homo sapiens
  misc_feature: GZ8MTXP02I13UC.19.10.A10.1.454.CMB.2.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccgggggtcctgagactctcctgtagaagttatggattcaacttcgctagcggctggctgtgctggtcnccgaggctcgagggagggctggagtgggtgccgnagtacgaagaggagatagtaggaaggggaggacgaacgagaccgtaccgctcggcctacccggtgacggaggcagtaactttaccatagacgaaagagtatagtaattacaactaaaagtactagtagtactctagaactaaatacgaaacacgaccgtaagaaacggaccggaacgaaccaacgagacccttaatttaactaagttagtaaaacaaaagtacggtaaaaggttacgggtaagggggggaaaacgggggttaaacgtacggggggtacccaaacgggggtaacccgttcgggttaccgtacccggttcgtcccggtaccgaaccgtccccg

SEQ ID NO: 316866 - DNA, 599 bp, Homo sapiens
  misc_feature: GZ8MTXP02FJCU5.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgaggggagggctgggagtgggttggccgcatcaagaggagatagtaggaagggggaggcgacagactaccgctgcaccgtgagaggcagtactttaccatgtacaaagagtatgattacaacaaagtacaggtagtaactcgtagacaaaatgaaacagtccctagaaacgaccggaaggaaccacacgacctaagtttactaattacgtaacaaaataggaaatacggtagggggaacgggggtaaaagtcggggaacgacgggaaccgtggtacctccgtctcggtcacgtcccg

SEQ ID NO: 316867 - DNA, 652 bp, Homo sapiens
  misc_feature: GZ8MTXP02JOEDZ.19.10.A10.1.454.CMB.2.raw
  modified_base (284)..(284): a, c, t, g, unknown or other
  misc_feature (284)..(284): n is a, c, g, or t
  modified_base (439)..(439): a, c, t, g, unknown or other
  misc_feature (439)..(439): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (645)..(647): a, c, t, g, unknown or other
  misc_feature (645)..(647): n is a, c, g, or t
  modified_base (649)..(649): a, c, t, g, unknown or other
  misc_feature (649)..(649): n is a, c, g, or t
  modified_base (651)..(652): a, c, t, g, unknown or other
  misc_feature (651)..(652): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaaggggctggagtgggttggccgcatcaagaggagatatggaaggggaggcgacagactacgctgcacccgtgagaggcagatttaccatgtacaagagatgattcaacaaagtacagtgtatctgacaaatgaacagcctagaagacgagacanagcctatttactattgaacaaatagaagtacggtaggggggaaacgggggtaaaagttcgggggaccgacggggaaacccgtggtaccccgtccgtcgtcgtacgacgccctaccaccgtaaacgggccctacgtcccggttcccttacccccgnggccctccccgtggacccctaccgaacgggtccgacccgaacccctcccggaaagacgaccgaccgaccggtccgggccccgttggggccctcgggccccttgggacccaaacggtacctacccggttacccgaacggaagtacggtaaccgtgggaaaccgggtccgggcgtacggggaccgaagggcccgaacagtaggngncnnncncnn

SEQ ID NO: 316868 - DNA, 640 bp, Homo sapiens
  misc_feature: GZ8MTXP02ISCON.19.10.A10.1.454.CMB.2.raw
  modified_base (419)..(419): a, c, t, g, unknown or other
  misc_feature (419)..(419): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtgggttcgccaggctccgaggggaaggggctggaggtgggtggccgcatcgaaggaggagatagtaggaaggggaggacgacagactaccgcgtgccgaccgtgagagcagtacttaccatgtacaaaganatagattacaaacgtaaagtacagttagtaactcgtagacaaatagaaacacgactagaaacggaccgaacggaacaacgaacgacctaatttaccgtaattagtaaaactaaaagtagtaaagtaccggggtaaaggggggtaaagggggtaaaacggttacgggggacctaacggggtaaccgttggtaccgtcccgtacgtccgtacaccgtaccccg

SEQ ID NO: 316869 - DNA, 601 bp, Homo sapiens
  misc_feature: GZ8MTXP02J0MKF.19.10.A10.1.454.CMB.2.raw
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgcgtggtcgccaggctccgagggagggctggagtgggtggccgcatcaagaggagatagtggaaggggaggcgacagactacgctgcaccgngagagcagtacttaccatgtacaaganatgaattcaaacaaagtacagtacgtaatctagacaaatagaaacaggcctagaaacgaccggaagacacgaacgacctaagtttactaattgtaaaactaaagtaggaaagtaccgggtagggggaaacgggggtaaaagtcgggggaccgaaggggaacccctgggtacctccgtcgtccggtaccacgtcccccg

SEQ ID NO: 316870 - DNA, 583 bp, Homo sapiens
  misc_feature: GZ8MTXP02JR6T6.19.10.A10.1.454.CMB.2.raw
  modified_base (477)..(477): a, c, t, g, unknown or other
  misc_feature (477)..(477): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggtcgccaggctccagggaagggctggagtggggttggccgcatcaaagaggagatagtaggaaacggggaggcgaacaggactaaccgctgcaccgtgagagcagattaccatgcaaagagatgattacaacaaaagtacagtagtatctagacaaaatgaaacagacctagaaacgaccgaagacanacgctaatttacattagaaacaaaatagaaatacggagggggaacgggggaaaattcgggggacaacggggaaccgtaggtctacggtactcggtaccacgacccc

SEQ ID NO: 316871 - DNA, 574 bp, Homo sapiens
  misc_feature: GZ8MTXP02IOFP7.19.10.A10.1.454.CMB.2.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctccagatagcaccggagaaattttcttgacgcagtctccaggcaccctgtctttgacccctgggaagagcccaccctctcctgcagggccgataagagtgttgacagctaccttcttgcctggtaccagcagagacctggccaggctcccaggctctcgttanggtncgtccacgnggccactgccactcccganacggttcagtggcagtgtcgtcgtgggacagtacttcgactctcnccatcagcagacgtgacgcgtgaatntttagctaggtntattacgtntacgaagtntatgatagcgtactaccgttacgtggtccgtatagttcggacgtaggggaaccgtaaggtttacgaaagggttaacaaaccggtaaacgtggttacgacgttacgacctaaccgtactccgttcgttacttaccgtactttccggttaacccccg

SEQ ID NO: 316872 - DNA, 618 bp, Homo sapiens
  misc_feature: GZ8MTXP02HE8F3.19.10.A10.1.454.CMB.2.raw
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
tcagtactctcgtgcacgaccggtgctcgatttagcgtcgatctcaggggggagaggagtcccagccttggggttcccgagtgttttcgttcagtgatcgggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgctgggttcnccaggctccgaggggaaggggctggaggtgggttggccgcatcaaggaggagatagtaggaaaggggagcganagactacgcctgcaccgtgagaggnagtatttacatgtacaaggagntagattacaacaaagtacagtgtaatcgtagactaaaatgaaacngacctaggaaacgaccgaggaaccacgacgtacctaatttactattacgtaaacaaaagtagaaaagtacgggtaacgggggaaacgggggtaaaattcgggggaccgtaacggggaaccctggtaccgtccgtacgtacgtaccacggtccctaacccg

SEQ ID NO: 316873 - DNA, 587 bp, Homo sapiens
  misc_feature: GZ8MTXP02JOA9S.19.10.A10.1.454.CMB.2.raw
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (535)..(535): a, c, t, g, unknown or other
  misc_feature (535)..(535): n is a, c, g, or t
  modified_base (553)..(553): a, c, t, g, unknown or other
  misc_feature (553)..(553): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(587): a, c, t, g, unknown or other
  misc_feature (582)..(587): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaacagcctagaaacgaccgaggacacagacctatttactattgtaacaaaatgaaatacgtagggggaacgggggtaaaattggggaccagggtaaccctggtccctccgtctcgtcacgccctcaccgacgggccacgtccggtccttcccccgnggcccncccgtgccctccagggactcccacccgtccggaagacgcacgacggccgtccccgtgggcctcgccgttacgggacaaacgggtccttaacccgttcccgagtacgacgttacncgggacggcggggtaccngggacgaacgggccgacgaataggngncnnnnnn

SEQ ID NO: 316874 - DNA, 592 bp, Homo sapiens
  misc_feature: GZ8MTXP02J0LUJ.19.10.A10.1.454.CMB.2.raw
  modified_base (193)..(193): a, c, t, g, unknown or other
  misc_feature (193)..(193): n is a, c, g, or t
  modified_base (241)..(241): a, c, t, g, unknown or other
  misc_feature (241)..(241): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanacgccaccctctcctgcagggccgataagagtgttgacagctaccttntttgcctggtaccagcagacgacctggcccaggcctcccgaggcctccttgtttatggtcgccgtccaccgagggcccacgtggcactccccganggttcagtgcagtgngtntgggacngtaccttcnctcctcnccancagcagctggacgctagaatntttgactagtgtattacgtgtactaacgatatgtatgtagtctaccgttcggtgtacggtacgtagtttcgggaccggtaggggtaccgtaagggttacgtaaacggtacgaaaacggtaacgttaggtacggtacgtaacggacctaaccgtacgttccgtacgttaccttcctacgttcccttccccg

SEQ ID NO: 316875 - DNA, 707 bp, Homo sapiens
  misc_feature: GZ8MTXP02F4P6G.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcgtggtccaggcccgggggtcctgagactctcctgtagaagttatggtattacaacttcgctagcggctggctgtgcgtgggttcgccgaggctccgaaggggaagggcgtgggaggtggggttcggccgcatacgaaaggaggagataagtaggaaggggagacgaagagactaccgctcgcacccgtgaggacgcgagtactttaaccagtgtacaaagagtatagtaattacgaaactaaagtaacgtagtagtaatcgtagaactaaatagaaactacgaccgtaaggaaaccggaaccggaaaggaaccacgaacgtacctaaattttaactaagttagtaaaactaaaagttaggtaaaacggttacgggtaaagggggtaaaacggggggtaaaaacgttacggggggaacccggtaaaaccgggggtaaaccccggttcggggttaaccgttccccggtacgtttaccggtaccgacccgtaacccccg

SEQ ID NO: 316876 - DNA, 649 bp, Homo sapiens
  misc_feature: GZ8MTXP02I502J.19.10.A10.1.454.CMB.2.raw
  modified_base (288)..(288): a, c, t, g, unknown or other
  misc_feature (288)..(288): n is a, c, g, or t
  modified_base (371)..(371): a, c, t, g, unknown or other
  misc_feature (371)..(371): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctccctgcagggccataagagtgtgacagctaccttctttgcctggtaccagcagagacctggccaggctcccgagctctgttanggtcgctccacgaggccacgtggcacgtccccgatcggttcaggtggcaggtgtgtctggggacagtacttcactcacacctntcagacagtacgtggacgctgaagtagttgactagttgttattactgtaccaaagtattaagtagtaagttagtacgttcctaacccgttaccggtagggttacggtaacgttacggtttacggggaccccggtaaagggggtaacccgtaaaaggggtttacggaaaacgggttaaaccgaaaaccggggtaaacgttaggggtcggtaaccgtcggacccgtaaacccgtattaccgttcggttaccttaccgtaacttccccggtttaacccccg

SEQ ID NO: 316877 - DNA, 659 bp, Homo sapiens
  misc_feature: GZ8MTXP02GPEWJ.19.10.A10.1.454.CMB.2.raw
  modified_base (400)..(400): a, c, t, g, unknown or other
  misc_feature (400)..(400): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggccccgggggtccctgagactctcctgtagaagttatggattcaacttcgctagcggctggctgtgcgtgggttcgccaggctccgaggggaaggggctgggaggtggggttggccgcagtcgaaggaggagagtagtagggaaggggaggcgacgagactaccgctcgcaccgtgagnggcagtatttaccatgtacaaagagtatgaattacaactaaaagtacagttgtatcgtagacaaaatcgaaacagacctaggaaacgacccggaagaaccaacacgtacctaatttaacctatttacgaaactaaaagtagaaacgttaacgggtacgggggggaaaacggggggtaaaacgttcggggggaacccgtaacgggggtaaaccccgttggggtacccttacccgggtctcggtaccgaccggtacccccg

SEQ ID NO: 316878 - DNA, 615 bp, Homo sapiens
  misc_feature: GZ8MTXP02HP3SU.19.10.A10.1.454.CMB.2.raw
  modified_base (377)..(377): a, c, t, g, unknown or other
  misc_feature (377)..(377): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgaccccctggggaaagagccaccctctcctgcagggccgataagagtgttgacagctaccttcttgcctggtaccagcagacgactggccaggcctcccgaggctcctcgtttatggtcgcgtcccacgacggggccacgtggccacgtcccccggataggttcaggtggcagtgtgtcgtgggacagtcttcactccncacctatcagtccagacgtggacgccgtagtaacgttagtttgacgttagttacgttagtttactggtactaaacgtattagtgtattaggtacgtaccctacccggttccggttgggtacggacttaggtttcgggaccggtaagggggtaccctaagggttacgaaacggtacgaaaacggtagtcggtacggctacggaccaacctagtcgtcgtacctctactttcctaccccg

SEQ ID NO: 316879 - DNA, 682 bp, Homo sapiens
  misc_feature: GZ8MTXP02HX7AL.19.10.A10.1.454.CMB.2.raw
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgtcttaattttaaaaggtgtcctgtgtgaggtgcgcctggtggagtcgtgggggaggcggtggtccgacggccccgggggtccctgagactctcctgtagaagttatggtattcaacttcgctagcggctggctgtgcgtggtcgccgaggctccgagggagggcgtggagtgggtgcgnagcaagagagagtagtaggaagggngcgaacgagactacgctcgcgacccgtagagagcgaagtatttaccagtacgtacaaagtagatagaacttaccaaagaaaacgtanaaaggtttntaactacgtagaactaaagtaacgaacgtacgaacgtaacggaaaccgaccggaacgtaacccaacgtaacttaacttaatttaactaacgtaaacgtaaaataacgtaaggtaaacgggtaaacgggggaaacggggggtaaaacggggtaaacggtaccggggaaccggtaaccgggtaaccgtcggtaccgtaccgtcgtacccgtaccgaccgtacccg

SEQ ID NO: 316880 - DNA, 624 bp, Homo sapiens
  misc_feature: GZ8MTXP02INFLM.19.10.A10.1.454.CMB.2.raw
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccaggcccgggggtccctgagactctcctgtagaagttatggattcaacttcgctagcggctggctgtgcgtggtcgcaggctcgagggagggctggaggtgggtgccgnatcgaagnggagatagtaggaaggggagcgacagactacgctgcaccgtgagngcagtattaccatgacaaagagatgatacaaataaagtacagttagtactctagactaaagtacgaaactacggacctaagggaaaacgaccgggaaaggacctaacgacgtacctaaagttttactattagtaaaactaaagtacgaaagtaaccggtaggggggaaaacggggtaaaagtcgggggaaccgaacgggtaaccccgtgggtacctccggtacgtaccgtacgtacgccccg

SEQ ID NO: 316881 - DNA, 655 bp, Homo sapiens
  misc_feature: GZ8MTXP02IYI6G.19.10.A10.1.454.CMB.2.raw
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggttcgccgaggctccgagggaaggggctgggaggtgggttggccgnagtcaaaggaggagatagtggaaggggaggcgacagactaccgctgcacccgtgagngcagtattaccatgtacaagagatgattacaaacgaaagtcaagtntaatctagacaaaatcgaaacacgtactaggaaacgacccgaaggacctaacgagtacctaaattttactagttaagtaaacctaaaagttcgaaaagttaccggggtaagggggggaaaacgggggtaaacgttacggggggacccgtaaaagggggtaaccccgttcgggttacccttacccgggtcgttaccggtacccgactacccccgg

SEQ ID NO: 316882 - DNA, 659 bp, Homo sapiens
  misc_feature: GZ8MTXP02JP6NP.19.10.A10.1.454.CMB.2.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccggggggtccctgagactctcctgtagaagttatggattcaacttcgctagcggctggctgtgctgggttcnccaggctccgagggagggctggagtgggtgccgcatcaagnggagatagtaggaaggggagcgacagactaccgctgcaccgtgagaggnagatttaccatgtacaganatgattcaacaaagtcagtgtatcgtagacaaatgaaaccagacccgtagaaacgaccggaagaccacgacgtaccctatttaacctagtttacgaaaactaaaagttacggaaaacgttaacgggaggggggggtaaaacgggggtaaaaacggtttccggggggaacccgtaaaacggggggaaaacccccgttgggggttaacccgttacccgggttccgttaccggttaacccgaccgggttaaccccccg

SEQ ID NO: 316883 - DNA, 548 bp, Homo sapiens
  misc_feature: GZ8MTXP02FLTL8.19.10.A10.1.454.CMB.2.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (506)..(506): a, c, t, g, unknown or other
  misc_feature (506)..(506): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
  modified_base (541)..(548): a, c, t, g, unknown or other
  misc_feature (541)..(548): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggagcgacagactacgctgcacccgtgagaggcagatttaccatgtcaagagatgattcaacaaagtacagtgtatctgacaaatgaacagcctagaagaccgaggacacagcctatttactatgacaatgaagtacgagggggaacgggggaaattcggggaccaggggtaccctggtccctccgtctcgtcacgccctccacgacgggcccagtccgtccttcccgnggccnccctgcctcgaggacnccaccncgagacgcacngccggcccgngggcctacgccgtagggtaccaacggtacctaccttcccgaaggtacgagttacgnggacggccgggngtacggacgacggcagatagngnnnnnnnn

SEQ ID NO: 316884 - DNA, 616 bp, Homo sapiens
  misc_feature: GZ8MTXP02I9KQQ.19.10.A10.1.454.CMB.2.raw
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggtattttcctttctgctattttaaaaggtgtcctgtgtgaggtgcgcctggtggagtcgtggggaggcgtggtccgaggcccgggggtccctgagactctcctgtagaagttatggattcaacttcgctagcggctggctgtgctggtcncagctcgaggaggctggagtggtgcgnatcaagagaatnggaagggagcganagactacgctgcaccgtgagagcagtattaccatgtacaagagatgaattacaagtaaaagtacagtgtaatcagtacaaatgaaacctagacctagaaacgacgaggaacaacgagacctaatttacatttacgtaaacaaaagttcgaaaagtttaccggaggggggtaaaacgggggtaaaagttccggggggaacctaacgggggtaaacccccttggggtaacccttaccggttaccgtaccgtccaaccggtacccctaacccgg

SEQ ID NO: 316885 - DNA, 599 bp, Homo sapiens
  misc_feature: GZ8MTXP02JSUMX.19.10.A10.1.454.CMB.2.raw
  modified_base (500)..(500): a, c, t, g, unknown or other
  misc_feature (500)..(500): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctgggtggagtcgtggggggaggcggtgggtccaggccccggggggtccctggagactctcctgtagaagttatggattcaacttcgctaggcggctggctgtgcgtgggttcgccgaggctccgagggaggggctgggagtggggtgccgcatcaagaggagatagtaggaaggggaggacgacagactacgctgcacccgtgagaggcagtacttaccatgtacaaagagatagattacaacaaagtacagtgtatctagaacaaatagaaacagactagaacgacgagacacagctaattactatanaacaatacgaaagtacgggacgggggtaaacgggggtaaacgtcggggacgtaacgggaacccgtcgggtacctaccgtcgtccgtacgacgtaccccg

SEQ ID NO: 316886 - DNA, 639 bp, Homo sapiens
  misc_feature: GZ8MTXP02HHGM3.19.10.A10.1.454.CMB.2.raw
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagcccaccctctcctgcagggccgataagagtgttgacagctaccttcttgcctggtaccagcagacgacctggccaggcctcccgaggcctccgttacgtttagtcgggtcgccgtacccgacccgacggggccctaacgtcggacctaaccgtccccccggaagtacgggtttccaaggttcgggcctaggttggtcggttcgtacgggggaacctaggtacctttccaacttccttaccacctaatccgaacggtccaaggtaccgtgggacgtacccgtagaaagttattttggactagttgttacttactgtacaagtatagtagatgtagtctaccgtcgtggtcgactagttcggaccgtaaggggactaagggttacgaacgttacgaaacgtacgtgcgactgacaaccgtatcgtcgtacttcacttccgtacccg

SEQ ID NO: 316887 - DNA, 607 bp, Homo sapiens
  misc_feature: GZ8MTXP02HVN8Y.19.10.A10.1.454.CMB.2.raw
  modified_base (412)..(412): a, c, t, g, unknown or other
  misc_feature (412)..(412): n is a, c, g, or t
  modified_base (464)..(464): a, c, t, g, unknown or other
  misc_feature (464)..(464): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaggtgtcctgtgtgaggtgcgctggtggagtcgtgggggaggcgtggtccgaggcccggggggtccctggagactctcctgtagaagttatggattcaacttcgctagcggctggctgtgcgtggtcgcaggctccgagggagggcgtggaggtgggtggccgcatcgaaggaggagatagtaggaaggggagcgaacgagactacgctcgcgaccgtgagaggcagtacttaccatgtacaaagngaatgtaattacaaacaaagtacagtagtattacgaagactaaaatgaaacncgacgtagaacgacgagacacgagtacctaagtttactatagaaactaaagtagaaacgtacggtagggggaaacgggggtaaaacgtcggggaaccgtacggggtaaccgtggtaccgtccgtacttcggacacgtaccccg

SEQ ID NO: 316888 - DNA, 613 bp, Homo sapiens
  misc_feature: GZ8MTXP02JITVY.19.10.A10.1.454.CMB.2.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgcgtgggtcnccaggctccgagggagggctggagtgggtgccgnagtcaagaggagatagtggaaggggngcgacagactacgctgcaccgtgagngcagattaccatgcaaganatgattacaacaaagttacagtgtaatcgtagacaaaatgaaactagccgtagaaacgaccggaagtaccacgacgtacctatttaactattacgaaactaaaatggaaaagtaccggggtaaggggggtaaacgggggtaaaacgttcgggggaacccgtaagggggtaacccgttgggtacccgtccggtctccggtaccacgtacccccg

SEQ ID NO: 316889 - DNA, 639 bp, Homo sapiens
  misc_feature: GZ8MTXP02IMTOZ.19.10.A10.1.454.CMB.2.raw
  modified_base (292)..(292): a, c, t, g, unknown or other
  misc_feature (292)..(292): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgctgggtcnccaggctccgagggagggctggaggtgggtggccgcatcaaggaggagatagtaggaaggggaggacgacaggactaaccgctacgccaccccggtgaaggacggcaagtactttaacccagttcgtacaaaggtagaatagaattacaaactaaaagtacagttagttatctagacaaaatagaaacagacctagaaagaccggaagacaacgagacctaatttaacgtattagtaaaactaaatacgaaatacggtaagggggaaacgggggtaaaagttacgggggaccgaacgggggtaacccgtgggtaccccgtaccgtacgtaccggtctaacgaccccg

SEQ ID NO: 316890 - DNA, 664 bp, Homo sapiens
  misc_feature: GZ8MTXP02GB8DO.19.10.A10.1.454.CMB.2.raw
  modified_base (194)..(194): a, c, t, g, unknown or other
  misc_feature (194)..(194): n is a, c, g, or t
  modified_base (425)..(425): a, c, t, g, unknown or other
  misc_feature (425)..(425): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgacccctggggaaanagcccaccctctcctgcagggccataagagtgttgacagctaccttcttgcctggtaccagcagagacctggccaggcctcccgaggcctcctcgtttagtggtcgccgtcccaccgagggccctacgtggccacgtcccccgagtacggttcaggtcggctaggtgtcggtcgtaggggacctaggtaccttcgaacttccacaccgtatccgagccagacgtggggacnccgtagtaaagttcgtttgacgttagttacgttactttacgttacggtaactaaacgttattaagttaggtaagttacggtaaccggttacccgtaaccccggttccgggttagggtacggtaaccgttaggtttacgggaccggtaaggggtaccgtaaggtacgtaaacgtacgaaaacgtagtcggtacgcgtacgactaacgtacgttctacgttctacctacttcccgttaccg

SEQ ID NO: 316891 - DNA, 662 bp, Homo sapiens
  misc_feature: GZ8MTXP02F4ZDB.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccgagggaaggggctgggagtgggttggcgcatcaaggaggagatagtggaaagggggaggacgacaggactaccgctgcacccgtgagagggcagatttaccatgtacaaagagtaatgtaactttacaactaaaagtaactagtagttaatctagaacaaatagaaacaggacccgtagaaacgaaccggaaggaaccaacgacgacctaagtttactaaagtttagtaaaactaaaagtagaaacgttaacgggtaaggggggaaacgggggtaaaaacggtttcggggggaacccgaacgggggtaaacccccgttcgggttaccgtcccggttccgtaccggtacacggtacccccg

SEQ ID NO: 316892 - DNA, 771 bp, Homo sapiens
  misc_feature: GZ8MTXP02IUM4I.19.10.A10.1.454.CMB.2.raw
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagctaccttcttgcctggtaccagcagagaccgtggccaggcctcccgaggtcctccttcggtttatcggtcgccgtacccaccgtacgggccaacgtggacctaccgtcccccggaagtacggtttaccgaggttcggccgtaggtttggtcggttaccgttaccgggggaactaacggtaccctttaccgaacccttcccttacccacccgtacttacccgaacggaccgaaggtaccgtaggggtaaaccgtcccgtaggtaaacgttagtttttcggacgttaagttgtttaactttacgtacgttaaccgaaacgtaatagttagtagttacggtaacgttacccgtacccgttaccggtagggtaccggtaagttacggtttacggggaacccggtaacgggggtaaaaccgttaacgggtttaacggtaaaacggttaaaccgaaaaccggtaaacggttggttacggtaccgtacggtaccgtaactaacgtccgtttacgtacccgtttactaccgtttccctttacccccg

SEQ ID NO: 316893 - DNA, 624 bp, Homo sapiens
  misc_feature: GZ8MTXP02G820W.19.10.A10.1.454.CMB.2.raw
  modified_base (294)..(294): a, c, t, g, unknown or other
  misc_feature (294)..(294): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgcgtgggtcnccaggctccgaggggaagggctggaggtggggttggccgcatcgaaaggaggagatagtaggaaggggaggacgacgagactaccgctgccacccgtgacgaggcagtactttaccagtgtacaagagatgaattacaaacgtaaaagtacgtagttagtattaccgtagacaaaagtagaaactagaccgtaagaaacgaccggaaggacacgagacctatttactagttacgaactaaagtgaaacgtacggtagggggaaacgggggtaaagtcgggggacgtaacgggaacccgtggtaccgtccgtacgtcgtaccgacgtcccg

SEQ ID NO: 316894 - DNA, 601 bp, Homo sapiens
  misc_feature: GZ8MTXP02JSO0I.19.10.A10.1.454.CMB.2.raw
  modified_base (328)..(328): a, c, t, g, unknown or other
  misc_feature (328)..(328): n is a, c, g, or t
  modified_base (402)..(402): a, c, t, g, unknown or other
  misc_feature (402)..(402): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccagcccggggggtccctgagactctcctgtagaagttatggattcaacttcgctagcggctggctgtgctggttcgccaggctccgagggagggctggagtgggtgccgnatcaagaggagatagtggaaggggaggcgacagactaccgctgcaccgtgagagcagattaccatgtacaaganatgattcaacaaagtacagtgtatctgacaaatgaaacagcctagaagaccgaagacacgacgacctatttaactattacgtaaactaaaagtcgaaaagtacgggtaggggggaaaccgggggtaaaagttcgggggaacccgtaaggggaaccccgttggggtaccctccggtaccgtcgttaccacggtacccccg

SEQ ID NO: 316895 - DNA, 633 bp, Homo sapiens
  misc_feature: GZ8MTXP02GLZVD.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggtcgcaggctccgagggagggctggagtgggtggccgcatcaagaggagatagtggaaggggaggcgacgagactaccgctgcacccgtgacgaggcagactttaccagtcgtacaaagagaatgtaattacaaacaaagtacagttagtatctagacaaatagaaacagcctagaacgaccggagaaccaacacgacctaagtttaactagtttagtaaactaaaagtaggaaacgttaacgggtaacgggggggaaacgggggtaaaaggttcgggggaacccgaagggggtaacccccgtggggtaccctccggtaccgtacggtccgaacggtccccc

SEQ ID NO: 316896 - DNA, 654 bp, Homo sapiens
  misc_feature: GZ8MTXP02FNZOE.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggccccgggggtccctgagactctcctgtagaagttatggtattcaacttcgctagcggctggctgtgcgtgggttcgccgaggctccgaggggaaggggctgggaggtggggttggccgcatacgaaggaggagaagtagtagggaagggggaggacgacgagacctaccgctcgccacccgtggagaggcagtactttaccatgtacgaaagagatagacttacaaacgtaaagtacagtcgtaatctagaactaaagtagaacagacctagaacgaaccgagaactacaacgcctaatttactattacgtaacgaaaatagaaacgtacgggtaaggggggtaaacgggggtaaaacgtcgggggaacccgtaaacgggggtaaccccgttgggtacccgttccggtaccgttcgaccgaccgtacccccg

SEQ ID NO: 316897 - DNA, 623 bp, Homo sapiens
  misc_feature: GZ8MTXP02GEH9W.19.10.A10.1.454.CMB.2.raw
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggcctccgaggggaagggctggagtggggttggccgcatcaaggaggagatagtaggaaggggagcgacagactaccgctcgcaccggtgacgagcagatttaccatgtacaaagagatgaattcaacaaaagtcagtacgttanctgacaaagtgaaacngcctaggaaacgacgaacggaaccagaacgcccttaaatttactaattagtaaaacaaaagtcggtaaatacggggtaaggggggaaaccgggggtaaaagttcgggggacctaacgggggaacccgttcgggtacctccggtctaccgtcgaccgtaccccg

SEQ ID NO: 316898 - DNA, 602 bp, Homo sapiens
  misc_feature: GZ8MTXP02FNTKV.19.10.A10.1.454.CMB.2.raw
  modified_base (431)..(431): a, c, t, g, unknown or other
  misc_feature (431)..(431): n is a, c, g, or t
  modified_base (593)..(593): a, c, t, g, unknown or other
  misc_feature (593)..(593): n is a, c, g, or t
  modified_base (595)..(602): a, c, t, g, unknown or other
  misc_feature (595)..(602): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagagtcagatttaccatgtcaagagatgattcaacaaagtacagtgtatctgacaaatgaacagcctgaagaccgaggacacagcctatttactattgtaacaaatgaatacgtagggggaaacgggggaaaattcggggaccaggggaaaccctgggtaccctccgtctcgtcagtccctccaccgaaacggggcccctaagtccgggtccctttcccccgtgggcccnccccgttgcccctcccgaagggacgccgaccctcccggaagaccgccaacgacggccgggtccccgtgggggcctcggcccgtagggtaccaaagggtaccctacgttcccccgaagacgagtaactggacggcggggctggggacaacggggcacactagngnnnnnnnn

SEQ ID NO: 316899 - DNA, 637 bp, Homo sapiens
  misc_feature: GZ8MTXP02F9ZBS.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctgggtggagtcgtgggggaggcgtggtccaggcccgggggtccctgagactctcctgtagaagttatggattcaacttcgctagcggctggctgtgctggtcgcaggctccgagggagggctggagtgggtgccgcatcaagaggagatagtggaaggggaggcgacagactaccgctgcaccgtgagagcagtactttacatgtacaaagagatgaattacaaactaaagtacagtgttaatcgtagactaaaatcgaaacaggaccctaaggaaacggacccggaaggaaccacgaagtcccttaaatttactaattacgtaaaactaaaagtgtaaaagtacgggtaaggggggaaaacgggggtaaaacgttcgggggaacccgtaaacggggtaacccccgttgggtacctacccggtcgtaccgtaccgacgtacccccg

SEQ ID NO: 316900 - DNA, 691 bp, Homo sapiens
  misc_feature: GZ8MTXP02HNKU4.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccagcccgagggggtccctggagactctcctgtagaagttatggattcaacttcgctagcggctggctggtgcgtgggttcgccgaggcctccggaggggaaggggctggggaggtggggttgggccgcagtacgaaaggaggagagtagagggaaggggaggcgagacgacctacggctcgaccgacccggtggaggacgggcaaaggtattttaccagttcggtacaaagagtaacttaggaacttacaaacgtaaaagtacgagttagtacttcgtagaactaaatacgaaacaaggtcccaaggaaccgaacggacgactacgacgtactaatttactagtttaacgaaactaaaagttgtaaaacggtaccggggttaaggggggaaaacgggggttaaacgttacgggggaccgggtaaaccgggtacccggtcggttaccgtccgttacgtccggtacctacccgg

SEQ ID NO: 316901 - DNA, 724 bp, Homo sapiens
  misc_feature: GZ8MTXP02HD1F6.19.10.A10.1.454.CMB.2.raw
  modified_base (712)..(712): a, c, t, g, unknown or other
  misc_feature (712)..(712): n is a, c, g, or t
  modified_base (714)..(715): a, c, t, g, unknown or other
  misc_feature (714)..(715): n is a, c, g, or t
  modified_base (717)..(724): a, c, t, g, unknown or other
  misc_feature (717)..(724): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaaacacgcctagaacgaccgaaggacacacgacctaatttactaattacgtaaactaaaatgtaaagttacggtagggggggtaaacggggggtaaaagttcgggggaaccgtaacggggtaaacccgttcggtaccccgtcccgtccgttaccgtaccgacgtacccccttacccgacccggaaccggggtacccctaccgttccccgggttaccccctttccccccgcgggtcccccggtccccgttacggccccttacccggaacggggtacccaccccgtaacccggtacccggaacggaaccgacccgaaccgaccgggccccgggtcccgtcggggtccttccggcccggttagggtaacccgaaacgtacccgttaccctaccccgaaacggtaacgtaaacgtcggaacgggtccgggcgtacggacgaacgggcaccgtaagngnngnnnnnnnn

SEQ ID NO: 316902 - DNA, 674 bp, Homo sapiens
  misc_feature: GZ8MTXP02JS5QH.19.10.A10.1.454.CMB.2.raw
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (411)..(411): a, c, t, g, unknown or other
  misc_feature (411)..(411): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttaattttaaaaggtgtcctgtgtgaggtgcgcctggtggagtcgtgggggaggcgtggtccgaggccccgggggtccctgagactctcctgtagaagttatggtattactaacttcgctagcggctggctgtgctggtcncgaggctcgagggaggctggagtgggtgccgnatcgaagagganatagtggaaaggggnggacgacgagactaccgctgccaccgtgagacgcagtacttaccatcgtanaagagtatgtaacttacaagtaaagtacgtagttagtatacgtagaaaccttaaagacgaaacgtaacgacgtaaggaaacgacccggaaagaaccaacgacgtaccttaatttaactaacgtttaagaaactaaaagtaaggaaacgtaacgggggtaaagggggtaaacgggggtaaaacggtaccgggggaaccggtaaaccgggtaaacccggtcggttacccgtccggttaccgtaccggtaccgtaaccggcccccg

SEQ ID NO: 316903 - DNA, 536 bp, Homo sapiens
  misc_feature: GZ8MTXP02G9F33.19.10.A10.1.454.CMB.2.raw
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
  modified_base (505)..(505): a, c, t, g, unknown or other
  misc_feature (505)..(505): n is a, c, g, or t
  modified_base (527)..(527): a, c, t, g, unknown or other
  misc_feature (527)..(527): n is a, c, g, or t
  modified_base (529)..(536): a, c, t, g, unknown or other
  misc_feature (529)..(536): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggagcgacagactacgctgcaccgtgagaggcagatttaccatgtacaagagatgattcaacaaagtacagtgtatctgacaaatgaacagcctagaagaccgaggacacagccatttactattgaacaaatgaaatacggtaggggaacgggggtaaaattcggggaccagggaccctggcctccgtctcgcacgcctcaccgaacgggccctagtccgttcctcccccgnggcccgccctgcctccgaggcgcaccgtccgagacgcacgcgccggccctgggcncgcgtgggtacaacggctacctccacgancgactggacgccgggntacggcgaacggcgcgaatggngnnnnnnnn

SEQ ID NO: 316904 - DNA, 689 bp, Homo sapiens
  misc_feature: GZ8MTXP02F93WR.19.10.A10.1.454.CMB.2.raw
  modified_base (265)..(265): a, c, t, g, unknown or other
  misc_feature (265)..(265): n is a, c, g, or t
  modified_base (680)..(680): a, c, t, g, unknown or other
  misc_feature (680)..(680): n is a, c, g, or t
  modified_base (682)..(689): a, c, t, g, unknown or other
  misc_feature (682)..(689): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctgggagtgggttggccgcatcaagaggagatatggaaggggaggcgacagactacgctgcacccgtgagaggcagtatttaccatgtacaagagatgattacaacaaagtacagtgtatctagacaaatnaacagcctagaacgaccgaggacacagacctatttactattacgtaaactaaatagaaacgtacgggtaggggggaaacggggggtaaaagttcggggaaccgaacggggtaaccccgttgggtacccccgtccgtctccggtccacggccccctaccacccggaaacgggcccctaacgtccccggttccccttccccccgtcgggccccgtcccccgtaggtccccctaccggaaacgggccaccccgtacccccgtacgaacggaccgaccaaaccggccgggccccgggttcccccgttgggggccctttcggggcccgttaggggacctaaaaccgggcccttaaaccctccgaaacggtagtacgttacgcgagggtccgggctaggggaccaaggtccgaactagtangnnnnnnnn

SEQ ID NO: 316905 - DNA, 669 bp, Homo sapiens
  misc_feature: GZ8MTXP02JC5DY.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctgagactctcctgtagaagttatggattcaacttcgctagcggctggctgtgcgtgggttcgcgaggctccgaggggaagggcgtggaggtggggttggccgcagtacgaaggaggaagatagtaggaaggggaggacgacaggactaccgctgccaccgtgaggagcagtaatttaccatgtacaaagagaatagtattacaacaaaagttacaaggttagtaatcgtagaccaaaagttcgaaactacgacctaggaaccgaaccggaaggaacaacgacgacctaatttactaattagaaaacaaaagtcgaaaagttaccggggtaaggggggtaaaacgggggtaaacgtttcgggggaacccgtaaacggggtaaccccggttgggttacccgttacccggtcttaccgggttacaccgtaacccccg

SEQ ID NO: 316906 - DNA, 626 bp, Homo sapiens
  misc_feature: GZ8MTXP02GABGV.19.10.A10.1.454.CMB.2.raw
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgacccctggggaaagagccaccctctcctgcgagggccgataagagtgttgacagctaccttcttgcctggtaccagcagagacctggccaggcctcccgaggcctccttcgtttagtggtcgccgtccaccgagggccacgtggccactccccganaggttcaggtggcagtgtgtcgnggacagtactcactcncacntcagctagacgtggacgcgtagaacgtatttgctagttgttacttagtcgtacaacgtatagtgtagtgacgtaccgtaccgttccggtaggtacggtacgttaggtttacgggaccggtaagggggtaaccgtaaaggggtttaacgaaaacgttaacggaaaacggtaaacgttggtacggtacgtacgaccgtaaccgtaacgttccgttacgttaccttaccgtaccgtttacccttcccccg

SEQ ID NO: 316907 - DNA, 646 bp, Homo sapiens
  misc_feature: GZ8MTXP02JE01A.19.10.A10.1.454.CMB.2.raw
  modified_base (293)..(293): a, c, t, g, unknown or other
  misc_feature (293)..(293): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtccctgagactctcctgtagaagttatggattcaacttcgctagcggctggctgtgctgggtcncaggctccagggagggctgggagtggggttgccgcatcgaagaggagatatggaaggggaggcgacagactaccgctgcacccgtgagaggcagactttaccatgtacaaagagatgattcaacaaagtacagtgtaatctgactaaatagaaacagcctaggaaacgacccggaaaggacctaaacaggtcccctaaattttaccaatttacggtaaaactaaaagttgaaaagttaccgggtaaaggggggtaaaaccggggggtaaaaagttcggggggaacccgtaaagggggaaaccccttcgggggtaccttacccgggtccttaccggtaccgaacggttcccccg

SEQ ID NO: 316908 - DNA, 557 bp, Homo sapiens
  misc_feature: GZ8MTXP02JZXFW.19.10.A10.1.454.CMB.2.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
tcagtactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggccaccctgtctttgacccctggggaaanagccaccctctcctgcagggccataagagtgtgacagctaccttnttgcctggtaccagcagagacctggccaggcctcccaggcctcctcgtttatggtgccgtccacgacgggcccacgtggcactccccganaggttccagtgcagtgtgtctggggacagttacttcactcncacatcagcagactggacgtcctagaagtatttgactagtagtattactgtacaacggtatagtgaatgagtcctaccgtcgtggtagactagttcggaccggtaggggacctaagggttagaaacggttcgaaaaccggtagtacggttacggaccgttaggacctaaccg

SEQ ID NO: 316909 - DNA, 587 bp, Homo sapiens
  misc_feature: GZ8MTXP02H5YQ8.19.10.A10.1.454.CMB.2.raw
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (513)..(513): a, c, t, g, unknown or other
  misc_feature (513)..(513): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgtctattttaaaaggtgtcctgtgtgaggtgcgcctggtggagtcgtgggggaggcgtgggtccaggccccggggggtccctggagactctcctgtagaagttatggtattcaacttcgctagcggctggctgngcgtgggtcgccgagcgtccgagggagggcgtggaggtgggtggccgnatnaagnggagatagtggaaggggaggacganagactaccgctgccaccgtgagngcagtattaccattgacgaaaganaagtagattacaacgtaaaagacgtaagtagtatctagactaaaatgaaacagacctagaacgaccgagaacagacgacctattactattacgaanaaatagagtaacgagggggaaacgggaaaagtcggggacgaacgggaaccgtcgtcgccgtgccgtacacgccc

SEQ ID NO: 316910 - DNA, 677 bp, Homo sapiens
  misc_feature: GZ8MTXP02HOPSY.19.10.A10.1.454.CMB.2.raw
  modified_base (399)..(399): a, c, t, g, unknown or other
  misc_feature (399)..(399): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctggagactctcctgtagaagttatggattcaacttcgctaggcggctggctggtgcgtgggtcgccaggctccgaggggagggcgtggaggtgggttcggccgcatcgaaaggaggagatagtaggaaggggaggcgagagactaccgctgccaccgtgacggngcagtattaccagtgtacgaaagagatagaacttacaaactaaagtacgagtagtatcgtacgaactaaagtagaaaccagaccgtaaggaaacgaacccgggaagaaccaacacgtaccctaattttaacgaagttttaacgaaaacgtaaaactaaggaaaacgtttacggggaaaacggggggttaaacgggggaaaacggtttacgggggaacccgaacggggttaaaccccgtgggtacccgttccggacgttcccggtacgaacggtccccg

SEQ ID NO: 316911 - DNA, 645 bp, Homo sapiens
  misc_feature: GZ8MTXP02G36SR.19.10.A10.1.454.CMB.2.raw
  modified_base (291)..(291): a, c, t, g, unknown or other
  misc_feature (291)..(291): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtcctgagactctcctgtagaagttatggattcaacttcgctagcggctggctgtgctggttcncaggctccgagggagggctggagtgggttgccgcatcaagaggagatagtggaaggggagcganagactacgctgcacccgtgaggnggtcagtactttaccatcgtanaaagagatcgattcaacaaagtcaagttntactctagactaaatacgaaacacgaccgtagaacgacggaagaaccacgtacgtaccttaatttacgtaattacgtaaaactaaaacgtaggtaaaacggttacgggggtaaacggggggtaaacgggggtaaaacggttcgggggaaccggtaacggggtaacccgttcgggtacccgttccggttaccgttaccggtaccgtaccgtaccccg

SEQ ID NO: 316912 - DNA, 709 bp, Homo sapiens
  misc_feature: GZ8MTXP02I7GCJ.19.10.A10.1.454.CMB.2.raw
  modified_base (343)..(343): a, c, t, g, unknown or other
  misc_feature (343)..(343): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgctggtggagtcgtggggaggcgtggtccgaggcccgggggtcctgacgactctcctgtagaagttatgattacactcgctagcgctggctgtgcgtggtcgcagctcgaggaggctggagtggtgcgcagtcaagaggagatagtaggaagggngacgacagacaccgctcgcaccgtgagagcagtacttaccagtgtacaagagagtagtaacttcgaaataaacgtacgtaagttaggtaacttcgtagaactaaaagttacggaaaacctacggtacccgtaaggaaaccggaaacccggaaagggaaaccccaacgaacggtacccctttaaaaggttttaacccttaaggtttaataaaaccgtaaaagttaacggtaaaggttacgggggtaaaaggggggtaaaaccgggggtaaaaacggtttccgggggaaacccgtaaccgggggtaaaccccgttagggttacccggttacccggttaccgttaccggtaccgtaaccggtacccccg

SEQ ID NO: 316913 - DNA, 587 bp, Homo sapiens
  misc_feature: GZ8MTXP02IKXW4.19.10.A10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
  modified_base (441)..(441): a, c, t, g, unknown or other
  misc_feature (441)..(441): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagcccaccctctcctgcagggccgataagagtgttgacagcacttcttgcctggtaccagcagagacctggccaggctcccaggctcctcgtttanggtgccgtccaccgagggcccacgtggccactcccccggaanacggtttccaggttggcaggttgtggtccgtggggacagtacttcactctccnccatccagccagactgggagcctgaagtatttgctagtgtattacgtgtacaacgtntatgaatgacgtctaccgtcgtggtggtactagtttcggaccggtaaggggaccgtaagggttaggaaacgtacgaaaacggtaaacgttcggtacggtacgtacgaccgaaccgtactcgttcgttaccttctactccttccccg

SEQ ID NO: 316914 - DNA, 597 bp, Homo sapiens
  misc_feature: GZ8MTXP02I8VR3.19.10.A10.1.454.CMB.2.raw
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
  modified_base (545)..(545): a, c, t, g, unknown or other
  misc_feature (545)..(545): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (592)..(594): a, c, t, g, unknown or other
  misc_feature (592)..(594): n is a, c, g, or t
  modified_base (596)..(597): a, c, t, g, unknown or other
  misc_feature (596)..(597): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgccaccgtgagaggcagatttaccatgtcaagagatgattcaacaaagtcagtgtatctgacaaatgaacagcctagaacgaccgaaggacaacagcctatttactattagtaacaaaatgaaagtacggtagggggacgggggtaaaattcggggaccaaggggaacccctgggtccctccgtctcgtacacgccctcccaccgaacgggccctacgtcccgggtcccttcccccggnggcccgccccgtgccctccgaggacncccaccgtccgacgacgcacgacggccggcccgtgggcttcgaccgtgggtaccaacggtccctacgtcccgaacgacgacgttacgngacgggccgggtactcgggacgaacggccgacgtagacgngngcgcnnncnn

SEQ ID NO: 316915 - DNA, 675 bp, Homo sapiens
  misc_feature: GZ8MTXP02GWLA9.19.10.A10.1.454.CMB.2.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggntggctgngcgtggtcgccaggctcgagggagggctggaggtgggtgccgcagtcaaggnggagatagtaggaaggggagccgaagagactaccgctcgccgacccgtggagaggcagtactttaccatcgtacaaagtagtatgaacttacgaaacgtaaaagtactaaggttagtaatcctaggaactaaaagtacgaaaccacggtaccgtaaggaaaccggtaacccggaaggaaaccaacgaacgtaccttaatttaactaagttagtaaactaaaagttaggaaagttaacggggtaaagggggaaaccgggggtaaaagttcgggggaacccggaaacggggtaacccgtgggttacccgtccggttacgtccgcgtaaccggtaccccg

SEQ ID NO: 316916 - DNA, 581 bp, Homo sapiens
  misc_feature: GZ8MTXP02FH353.19.10.A10.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttcgacccctggggaaanagccaccctctcctgcagggccataagngtgtgacagcacttcttgcctggtaccngcagagacctggccaggctcccaggcctccgtgtttanggtcncgtccaccgagggccacgtggcactcccccgagtaggttcagtcgggcaggttgtggtctggggactagtacttcactctcaccatcagcagtctgacgcctgaagtntttgctagtgtattacgtntacagatatgatgatctactccggtggtaggtactagtttcggaccggaaggggtaaccgtaagggttacggaaaacggttaaccgaaaacggtaaccgttaggtacgggtactgaccgaaccgtaattcttacggtccttacgtaccgttccttccccg

SEQ ID NO: 316917 - DNA, 664 bp, Homo sapiens
  misc_feature: GZ8MTXP02HMWE6.19.10.A10.1.454.CMB.2.raw
  modified_base (299)..(299): a, c, t, g, unknown or other
  misc_feature (299)..(299): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggcccggggggtccctgagactctcctgtagaagttatggattcaacttcgctaggcggctggctgtgcgtgggtccnccgaggcctccgaggggaggcgtgggaggtggggttcggccgcagtacaaaggaggagatagtaggaacggggaggacgacgagtactaccgctcgccgacccgtgaggagcaagtatttaccagtgtacaaaganatagaatttacaaacgtaaaagtactaggttntaattcgagacaaaagtcgaaacacgtccaaggaacgaaccgtaagactacgacgtcctaaatttactagttaagaaactaaaagtcggtaaaagtacgggtaaggggggaaaacgggtaaaacgtcgggggaaaccctaagggtaaccccggttgtacccgttacccgtacgtcccggtacgtaaccggtcccccg

SEQ ID NO: 316918 - DNA, 744 bp, Homo sapiens
  misc_feature: GZ8MTXP02F36NQ.19.10.A10.1.454.CMB.2.raw
  modified_base (730)..(730): a, c, t, g, unknown or other
  misc_feature (730)..(730): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
  modified_base (741)..(741): a, c, t, g, unknown or other
  misc_feature (741)..(741): n is a, c, g, or t
  modified_base (744)..(744): a, c, t, g, unknown or other
  misc_feature (744)..(744): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggtcgcatcaagaggagatatggaaggggaggcgacagactacgctgcacccgtgagaggcagatttaccatgtacaagagatgattacaacaaagtacagtgtatcgtagacaaatgaacagcctaagaacgacgagacacacgaccttaatttactattaacgtaaactaaagttaaggaacgttaacggggtaacggggggtaaaacgggggtaaacggttaccggggaaccggtaaaccggggtacccgttcggtccccgttcccgtccgtacgtaccgaccgtccctaacccgaccggaccgggaccccttacggttccccgttccccgttcccccggtcggcccccgttcccgcggttaccccgacggaacggaccggtacccctaaccccggtccggaaagacccgtacgaaacccgtccggggtcccccgggtcccgggttaggcccccgttcgggacccccgtttagggggtaacccaaaaccgggttccctttacccgggtaccccgaaagggtagtaaacggttccgaggaccggtcggggctacggaacgaaccggggtccaacgtaaggccngacgcncngcncan

SEQ ID NO: 316919 - DNA, 713 bp, Homo sapiens
  misc_feature: GZ8MTXP02GSHUK.19.10.A10.1.454.CMB.2.raw
  modified_base (193)..(193): a, c, t, g, unknown or other
  misc_feature (193)..(193): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagcccaccctctcctgcagggccataagagtgttgacagctacttcttgcctggtaccagcagacgacctggccaggcctcccgaggccttcccgttcgtttagtcggtcgcccgtcccgaaccgtacgggccctacgtcggccaaccgtcccccggagtacgggtttcaggttggctaggttgtcggtcacggggactagtaccttcaccgttcctacacccgtattacgaacgaccaacggtacgtaggggaccgtacccgttaaggtaacgttagttttcggactaggtttagttacgtttaacgtacgtaacgaaacgtattaacgtgtaagtagtacgtaccgtaccgtccggttaggtacggtacgttagttacgggaccggtaacgggggaccgttaaaggttacgggaaaaggttaccgaaaacggtaacgttcgggtacgggtaccgtacgtaccgtaaccgttaacgttcgttacggttaccttaaccgttcgtttaccctttacccccg

SEQ ID NO: 316920 - DNA, 640 bp, Homo sapiens
  misc_feature: GZ8MTXP02GSPQZ.19.10.A10.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
tcagtactctcgtgcacgaccggtgctcgatttagcgtcgatctcagggggggagaggagtcccagcccttggggttcccgagtgttttcgttcagtgatcaggactgaacacgtaggactcaccatggagtttggcctgagttggattttccttctgctattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcnccgaggctccgaggagggctggagtggtgcgnatcaagagagatagtggaaggggngagacagactacgctgcaccgtgagagggcagactttaccattgacaagagaatgaaacttcaaagtaaatacgtaggtatttaanccttagggaccaaaagttcggaaaaccncgacgtagaaacggaaccggaacgaaccacgtacgtaccttaactttaacgtattaacgaaaactaaacgtagaaacgtacggggtaaagggggtaaaccggggtaaacgtaccggggaccgtaaaacgggaaccccgttggtaccccgtaccgtcgtaccggaccaccgcccg

SEQ ID NO: 316921 - DNA, 592 bp, Homo sapiens
  misc_feature: GZ8MTXP02JJEFX.19.10.A10.1.454.CMB.2.raw
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctggtcgcagctccgagggaggctggagtgggtgccgnatcgaagaggagatagtaggaaggggaggacganagactacgctgccaccgngagnggcagacttaccatgtacaaagagaatgaattacaacaaaagtacaagtgtaatcgtagacaaatagaacagacctagaacgacggaagacacgagacctaatttactattagaaactaaatacgaaatacgggtaagggggaaacgggggtaaacgtacggggaccgtaacgggaacccgtggtacctccggtcgtcgtacgacgtaccccg

SEQ ID NO: 316922 - DNA, 581 bp, Homo sapiens
  misc_feature: GZ8MTXP02JFC4E.19.10.A10.1.454.CMB.2.raw
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (327)..(328): a, c, t, g, unknown or other
  misc_feature (327)..(328): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgcttattttaaaaggtgtcctgtgtgaggtgcgcctggtggagtcgtgggggagcgtggtccaggccccgggggtcctgagactctcctgtagaagttatggattcaacttcgctaggcggctggctgtgcgtggtcgcaggctccgagggaggctgggngtggtgcgnannaagngagatagnggaaggggngcgagagacacgctgccaccgtgacgngcgagtattaccatgtacaaagngtaagtgtattacgaaanaaagttacagttnaattcagacaaagtgaaacgcgacgtaggaaacgaccgagacacgactactaattagtactagaacaaagtagaagtacggaggggaaacggggtaagtacggggaccaacgggtaacccgtaggtcctcggtcctacggtcacgaccccg

SEQ ID NO: 316923 - DNA, 656 bp, Homo sapiens
  misc_feature: GZ8MTXP02I2CIM.19.10.A10.1.454.CMB.2.raw
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctgacgactctcctgtagaagttatggattcaacttcgctagcggctggctgtgctggtcgcaggctcgagggaggctggagtgggtgccgnatcaagagagatagaggaaggggngcgacgagactaccgctgaccgaccgtgaggaggccagtactttaccatgtacaagagatgtatacaaacaaagtacagtcgtatctagactaaaagtacgaaacacgaccgtagaaaacgacccgggaaggaaaccaacgaacgtacctaaactttaactaagttacgtaaaactaaaagtagtaaaacgtaacggggtaaacggggggaaaagggggtaaaacttaccgggggaccgtaaaacgggggtaaacccgttcgggttaccgtacccgttcggttacccgtacgtaccggaacccccg

SEQ ID NO: 316924 - DNA, 605 bp, Homo sapiens
  misc_feature: GZ8MTXP02GMROR.19.10.A10.1.454.CMB.2.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccgaggcccggggggtccctgagactctcctgtagaagttatggattcaacttcgctagcggctggctgtgcgtggttcgcaggcctcgagggagggctggagtgggtgccgnatcaagngagatagtggaaggggagcgacagactacgctcgcaccgtgagagcagtactttaccatgacaagagatgaacttacaaacaaagtcaagtgtatcgtagactaaaagtcgaaacagtacctaggaaacgaccggaaggtaccacacgccttaaatttctagttagaaacctaaatagaaagttacgggaaggggggaaacggggtaaaagtcgggggaaccaaggggtaacccttgggtccctaccggtctaccgcgacgtccccg

SEQ ID NO: 316925 - DNA, 642 bp, Homo sapiens
  misc_feature: GZ8MTXP02F0CKL.19.10.A10.1.454.CMB.2.raw
  modified_base (335)..(335): a, c, t, g, unknown or other
  misc_feature (335)..(335): n is a, c, g, or t
  modified_base (429)..(429): a, c, t, g, unknown or other
  misc_feature (429)..(429): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttccttctgctattttaaagtgtcctgtgtgaggtgcgcctggtggagtcgtgggggaggcgtggtccaggcccgggggtccctggagactctcctgtagtaagttatggattcaacttcgctagcggctggctggtgcgtggttccgcgaggctccgagggaagggctgggagtgggttgccgcancgaagaggagatagtggaaggggagacgagagaactacgctgacaccgtgaagagcagtattaaccagtagtacaaagagatgattaaccaaanaaagtacagtcgtaatctagaacaaatagaaacagtcctaaggaaacgaaccgaaggaacccaagtacgacttaacgtttaactaagttacgaataaaatcgtaaaagtaccggtaaggggggaaacggggtaaaagttcgggggaacccaaacgggggtaacccgtgggttacccgtaccccggttattaccggaccgtacggaaccccccg

SEQ ID NO: 316926 - DNA, 686 bp, Homo sapiens
  misc_feature: GZ8MTXP02HIIOY.19.10.A10.1.454.CMB.2.raw
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (415)..(415): a, c, t, g, unknown or other
  misc_feature (415)..(415): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcgtggtccgaggcccgggggtcctgagactctcctgtagaagttatggattcaacttcgctaggcggctggctgtgcgtggtcgcgagctcgagggaggcnggagtgggtgccgnatacgaaggaggagaatagtagggaaggggagacgaacgagactaccgctgccgaccgtgacgagctagtacttacatagtacaaaganagtagtacttaacgaaacgtaaagtactaagttgtactacgtagaactaaagtacgaaacacgtaccgtaagaaaccgaaccgggaagtaacccgacgacgtaacccttaagtttaacctaacgttaagtaaaacgtaaaagtacggtaaaacggttaaccgggggtaaaggggggtaaaacgggggtaaacggttaccgggggaacccggaaacggggtaacccgttcgggtacccgttaccggtcgtacccggtacgacccgtaccccg

SEQ ID NO: 316927 - DNA, 543 bp, Homo sapiens
  misc_feature: GZ8MTXP02FIC22.19.10.A10.1.454.CMB.2.raw
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
  modified_base (397)..(397): a, c, t, g, unknown or other
  misc_feature (397)..(397): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagccaccctctcctgcagggccataagagtgtgacagcaccttcttgcctggtaccagcagngacctggccaggctcccaggctccctcgtttanggtgccgtccaccgagggcccaacgtggcatcccccganaggttcaggtggctagtgtgtctggggaccagacttcactctacacccatcaagcctaagacctggggancctagaaacgtattttgctagttgtaactttactagtcaaacgtatagtgatgagtcacgttcgtggtgactagttggctaggggacaaggttacgaagtacaaaacgactacgtcgctgacaaccatctgtctcgactctacccg

SEQ ID NO: 316928 - DNA, 605 bp, Homo sapiens
  misc_feature: GZ8MTXP02GI5HR.19.10.A10.1.454.CMB.2.raw
  modified_base (286)..(286): a, c, t, g, unknown or other
  misc_feature (286)..(286): n is a, c, g, or t
  modified_base (497)..(497): a, c, t, g, unknown or other
  misc_feature (497)..(497): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgntgggttcgccaggctccgagggagggctggagtgggttgcgcatcgaagaggagatagtggaaggggaggcgacagactaccgctgcacccgtgacgaggcagactttaccatgtacaaagagatagtacttacaaacgaaaagtacgtaagtaggttatacgtagactaaaataggaaactagaccctaggaaacgaccggaagaaaccncgaaagcctaatttacattagaaactaaaatcgaaatacgggtagggggaacggggtaaaagtcgggacgacgggaaccgtgtaccgtccgtctacgtcacgtacccg

SEQ ID NO: 316929 - DNA, 640 bp, Homo sapiens
  misc_feature: GZ8MTXP02JJQU4.19.10.A10.1.454.CMB.2.raw
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggcccgggggtccctgagactctcctgtagaagttatggattacaacttcgctagcggctggctgtgcgtgggttcgccgagctccgagggagggctggagtgggtgcgnancaagngagatagaggaaggggngcganacgactacgctgcaccgtgagngcagtacttacatgtacaaagagatgtataccgaanaaaagtcagtgtaaacttcgagaactaaaagtaccgaacgtacgtaccctagggaaaacgaccgggaacggaacacgaacgtaccttaagtttactagtttaacaaaactaaagtacgaaaaggttaccggggtaaagggggaaccgggggttaaagttaccgggacccgaaacggggtaacccgttggggtcctacccgttgacccgttagcctaaccccg

SEQ ID NO: 316930 - DNA, 632 bp, Homo sapiens
  misc_feature: GZ8MTXP02JJAP8.19.10.A10.1.454.CMB.2.raw
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtggggagcgtggtccaggcccgggggtcctgagactctcctagtagtaagttatggattcaacttcgctagcggctggctgtgcgtggtcgcaggctcggaggaggctggaggtgggtgcgcanacgaaggagganagtagtaggaaggggngacgagacgacacccgctcgacgacccggtgacggacgcgtagtaactttaccgagttagacgaaagagagttnaacttaaccgaaagtaaattacgtattagtacttcgagtaaacaagtaagacgacgtacgaggaaaccgacgaagaaccacgacgtacctaagtttactagtaacgaataaaagtagaaaggtacgggtaagggggaaacgggggtaaactccggggaggaaccgggtaaccgtcgtacgtaccgtcgtaccggtcacggacccc

SEQ ID NO: 316931 - DNA, 639 bp, Homo sapiens
  misc_feature: GZ8MTXP02FND8J.19.10.A10.1.454.CMB.2.raw
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggccccgggggtcctgagactctcctgtagaagttatggattcaacttcgctagcggctggctgtgcgtgggttcgccaggctccgagggaggggctggaggtgggtggccgcatcgaaggaggagatagtaggaagggggaggacgaacgaaggactaaccggcgtcgaccacccggtgaaggagggcaagtactttaccagttgtacgaaaggagtaatgtaaacttcaaaacaaaaggtataggtcgttaatacgtagtacaaagtacgaaacgacgccgtagaacgacgaggaaccagacactatttaactattagtaacaaaagtcgaaagtacgggagggggaaaccggggtaaaagtcggggacgtaacgggaaccgtcggtaccgtccgtacgtcgtacgacggtaccccg

SEQ ID NO: 316932 - DNA, 642 bp, Homo sapiens
  misc_feature: GZ8MTXP02FS71W.19.10.A10.1.454.CMB.2.raw
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgctgggttcnccaggctccgagggagggctggagtgggtgcgnagtcaagaggagagtagtggaaggggaggacgacgagactacgctgcaccgtgagaggcagactttacatgtacaagagatgattacaaactaaagtacagtgtaactctagaaacaaatacggaaacagaccctagaaaacgaccggaagaacccaagacgtaccctaatttactaagttacgaaaactaaaagttacgaaaagttaccgggtaagggggggaaaaccgggggtaaagttacgggggacccgtaacgggggtaaaccccgttgggttaacccgtcccggtacgtaccggttacacggtaccccc

SEQ ID NO: 316933 - DNA, 759 bp, Homo sapiens
  misc_feature: GZ8MTXP02GD8U4.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggttcgccaggctccgaggggaggggctgggaggtggggttggccgcatacgaaggaggagatagtagggaaagggggaggacgaacgaaggaccgtacccgctcgaccaccccggtggaacggagggccaaggtaacttttaaccgagttacgtacaaaggagtaattggtaaactttaccaaaacgtaaaagttacgtaaggttagttaacttacgtagaaacaaaagtagaaaaccacgtaccgtaaggaaacggaaccgggaaggaaccaacgtaacgtacccttaaattttaaccttaagtttacgtaaaactaaaagttaggtaaaacgttaacgggggtaaaggggggtaaacgggggtaaaaaggtttcggggggaacccggtaaaccgggggtaaccccgttacggggttacccgttacccgggttaccgttaccggtaccgaacccggtacccccg

SEQ ID NO: 316934 - DNA, 699 bp, Homo sapiens
  misc_feature: GZ8MTXP02FOCWD.19.10.A10.1.454.CMB.2.raw
  modified_base (336)..(336): a, c, t, g, unknown or other
  misc_feature (336)..(336): n is a, c, g, or t
  modified_base (439)..(439): a, c, t, g, unknown or other
  misc_feature (439)..(439): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaggtgtctgtgtgaggtgcgcctggtggagtcgtgggggaggcggtggtccgaggccccgggggtccctgagactctcctgtagtaagttatggattacaacttcgctaggcggcttggctgtgcgtggtcgcgaggctccgagggagggcgtggaggtgggttggccgnagtacgaaggaggagtagtagtagggaaggggaggacgagaggacctaccgcgtcggaccaccggtggaaggacggcgtaagtactttaaccagttacgtaanaaaggtagtaagtgtaaacttacaaacgtaaaagtacgtagttacgtaattcgtagaaacgtaaagtacgaaacgacgtaccctaggaaaccgaaccggaacggaaccacgacgacctttaattaaccgttagtaacgtaaataaaacgtaggaaacgttacgggggtaaacgggggaaacggggtaaaacgggttaccgggggaccgaaaccggggtaaccgttcggtaccctacgtacgttcgcctaccggtaccccg

SEQ ID NO: 316935 - DNA, 607 bp, Homo sapiens
  misc_feature: GZ8MTXP02FHT1Y.19.10.A10.1.454.CMB.2.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (451)..(451): a, c, t, g, unknown or other
  misc_feature (451)..(451): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggtattcaacttcgctagcggctggctgtgctgggttcnccaggctccgagggaagggctggagtgggtgccgcatcaagaggagatagtggaaggggagcganagactaccgctgcaccgtgagaggcagatttaccatgtacaaagagatgtaattcaataaagtacagtgtaatctgtacgaaaatgaaaccngacctagaacgaccggagaccacgagacctaatttacatttagaaactaaaatagaaacgtacggtaggggggtaaaccgggggtaaaaagttcgggggacctaaagggggaaacccttcgggaccgttcccgtagtccggtacaacgtacccccg

SEQ ID NO: 316936 - DNA, 648 bp, Homo sapiens
  misc_feature: GZ8MTXP02FJSM6.19.10.A10.1.454.CMB.2.raw
  modified_base (295)..(295): a, c, t, g, unknown or other
  misc_feature (295)..(295): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtcctgagactctcctgtagaagttatggattcaacttcgctagcggctggctgtgcgtgggttcncaggctccgagggagggctggagtgggtgcgcatacgaaggaggagagtagtaggaaggggaggcgacgagactacgctgccaccggtgaggaggcagactttaccagtgtacgaaagagtaatgattacgaaactaaagtacagtctaatcgtagaacaaagtagaaacacgacctaggaaaccgaccgggaagaaccaacgacgtaaccctaaacgttttaactaatttacgaaaacaaagtaggtaaaacgttacggggtacggggggaaaagggggtaaaacgttcgggggaccgtaaacggggaacccgttagggtcccgtacggtccgtcggtacgaccgtaccccg

SEQ ID NO: 316937 - DNA, 646 bp, Homo sapiens
  misc_feature: GZ8MTXP02HW1RW.19.10.A10.1.454.CMB.2.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgntagcgctggctgtgctggtcncaggctcgagggaggctggagtgggtgccgnatcaagnggagatagtggaaggggngacgacagactacgntcgcaccgtgagagcagtacttacattgacaaagagatacgtaattaccaaataaaaggtactaggttcgtaatcgtagacaaaagtgaaacagtcctaaggaaacgaccggaagaaccaacgtacgaccttaaatttactaattacgtaaactaaaatcggtaaaagtaaccgggtagggggggtaaaaccgggggaaaagtttaccggggggacctaaacgggggtaacccgttggggtaacccttacccggtcgttaccgggtacctaacggtacccccg

SEQ ID NO: 316938 - DNA, 603 bp, Homo sapiens
  misc_feature: GZ8MTXP02FP46E.19.10.A10.1.454.CMB.2.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
tcagtactctcgtgcacgaccggtgctcgatttagcgtcgatctcaggggggtagaggagtcccagccttggggttcccgagtgttttcgttcagtgatcaggactgaacacgtaggactcaccatggagtttggcctgagttggatttccttctgctatttaaaagtgtcctgtgtgaggtgcgcctggtggagtctggggaggcgtggtccgagccggggttccctgagactctcctgtagaagttatggattcaacttcgctagcggctggctgtgctgggttcncaggctcgagggagggctggagtgggttggccgnatcaagaggagatatggaaggggagcganagactaccgctgcacccggtgagaggcaagtactttaccgattgacaaagagatagattacaacaaagtacagtgtatctgacaaatgaaacncgactagaacgaccggagaccacgacgtacctaattaactagttagtaaaactaaaattacgaaagtacggggtaagggggtaaacgggggtaaaacgtcggggaaccgtaacggggtaacccgttcggtacccgtccgtacctacgtaccgacgcccg

SEQ ID NO: 316939 - DNA, 707 bp, Homo sapiens
  misc_feature: GZ8MTXP02GUXHY.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccgaggcccgggggtccctgagactctcctgtagaagttatggattacaacttcgctagcggctggctgtgcgtggttccgcgaggcctcgagggagggcgtggaggtgggtcggccgcgatacgaaggaggagtatagtagggaaggggacgacgaagaacgacgtaccgcgtacgaccacccggtgacgacggcagttaacttaccagtcgtaacaaagtagtaatgtaaacttacgaaaacgtaaaagttacgtaagttacgtaactaccgtaagaaactaaaagttacgaaacgtacgtacccgtaaggaaaccgaccgggaaacgaaccaacgacgtaccttaaagtttaactaagtttaacgaaaactaaagtacggtaaacgttacgggggtaagggggaaacgggggttaaacgtccgggggaacctaacggggtaacccgttcggtaccttaccggtcgtaccggtacacgtacccccg

SEQ ID NO: 316940 - DNA, 639 bp, Homo sapiens
  misc_feature: GZ8MTXP02GH9BQ.19.10.A10.1.454.CMB.2.raw
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccaggcccggggggtccctgagactctcctgtagaagttatggattcaacttcgctagcggctggctgtgcgtgggttcgcaggctccgaggggagggctggaggtgggtggccgnatcgaaagaggagatagnggaaggggagcgacagactaccgctgcaccgtgagagcagattacatgtacaaaganatgatacaaacaaagtacagtgtatcgtagacaaatagaaacagacctagaaacgaccggaagaaccacacgacctaatttactaagttaagtaaaactaaaatacggaaaagttaacggggtaaaggggggaaaacggggggtaaaaagttccgggggaaccgtaaacgggggtaaaccccgttcgggttaccgttacccggtccgtaccggtaccgaccgtacccccg

SEQ ID NO: 316941 - DNA, 671 bp, Homo sapiens
  misc_feature: GZ8MTXP02FYWFE.19.10.A10.1.454.CMB.2.raw
  modified_base (418)..(418): a, c, t, g, unknown or other
  misc_feature (418)..(418): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtggggaggcgtggtccaggcccgggggtccctgagactctcctgtagaagttatggattcaacttcgctagcggctggctgtgcgtgggttcgccgaggctccgagggaaggggctgggaggtgggttggccgcatcgaaggaggagatagtaggaaggggaggacgacagactaccgcgtgccaccgtgagaggcagactttaccatgtacaaganatagaattacaaacgtaaaagtacgagttagtaatcgtagacaaaatcgaaacacgtacgtaagaacgaccggaagaaccagacgaccttaagtttacctaagttacgtaaaactaaaagtaggaaaagttaccggggtaaagggggtaaaccgggggtaaaagtttcgggggaacccgtaaacgggggtaaacccccgttggggttaaccccgttcccggtaccgttaccggtacccgtaaccgtacccccg

SEQ ID NO: 316942 - DNA, 596 bp, Homo sapiens
  misc_feature: GZ8MTXP02IQQFG.19.10.A10.1.454.CMB.2.raw
  modified_base (316)..(316): a, c, t, g, unknown or other
  misc_feature (316)..(316): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (473)..(473): a, c, t, g, unknown or other
  misc_feature (473)..(473): n is a, c, g, or t
  modified_base (579)..(579): a, c, t, g, unknown or other
  misc_feature (579)..(579): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagtttggattttcctttctgctattttaaaaggtgtcctgtgtgaggtgcgcctggtggagtctgggggaggcgtgggtccaggcccggggggtcctgagactctcctgtagaagttatggattcaacttcgctagcggctggctgtgctgggttcgcaggctcgagggaaggggcnggagtgggtgccgcagtcaagagagatagtggaaggggagacganaagactacgctgaccacccgtgagaggcagtacttacatgtacgagantagattcaanaaacgtnagtcgtatctagacaaatgaaacagcccagaaacgaccggaagacanacgtacctaaatttacttatagttaaacaaaagtagtaaagtacgggtaagggggaacgggggtaaaagttgggggacccgaaggggaaccgtggtacgtccggtntccggtacacgtacccc

SEQ ID NO: 316943 - DNA, 635 bp, Homo sapiens
  misc_feature: GZ8MTXP02GINF2.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtggtcgcaggctccgagggagggctggaggtgggttggccgcagtcgaagaggagatagtggaaggggaggcgacgagacgtacgctgcgaccgtgagacgggcagtattaccatgtacaagagattgaaacttacaaacgtaaaagtacgtagtacgtatcgtagactaaaagcgaaacagccgtagaacgaccggaagaacctacacgtacctatttaacctagttacgaaactaaagtagaaacgttacgggtaggggggaaaacgggggtaaacgttcgggggaccgtaaacggggtaacccgttgggtaccttacccggtacgtccgcgtaccggtacccc

SEQ ID NO: 316944 - DNA, 638 bp, Homo sapiens
  misc_feature: GZ8MTXP02JET4P.19.10.A10.1.454.CMB.2.raw
  modified_base (336)..(336): a, c, t, g, unknown or other
  misc_feature (336)..(336): n is a, c, g, or t
  modified_base (627)..(627): a, c, t, g, unknown or other
  misc_feature (627)..(627): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaggtgtcctgtgtgaggtgcgcctggtggagtcgtgggggaggcgtggtccaggcccgggggtccctgagactctcctgtagaagttatggattcaacttcgctagcggctggctgtgctgggtcgccgaggctccgaggggaagggcgtgggaggtggggttggccgnagtcgaaggaggagatagtggaaggggaggcgacggagtaccgcgtcgaccacccgtgagaggcaggtactttaccagtgtacgaaagagatagattacaacgaaagtacagttatatacgtgactaaaatcgaaaacgcgaccgtaggaaacggaaccggagggaaccacgacgtcctagtttaactattagtaaacaaagtaagtaaagtacgggaacgggggaaacgggggtaaagttcgggggaaccggtacgggaacccgtggtaccgtaccgtcgcgtaccgacnccctaacccgg

SEQ ID NO: 316945 - DNA, 586 bp, Homo sapiens
  misc_feature: GZ8MTXP02ILA78.19.10.A10.1.454.CMB.2.raw
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
  modified_base (534)..(534): a, c, t, g, unknown or other
  misc_feature (534)..(534): n is a, c, g, or t
  modified_base (579)..(586): a, c, t, g, unknown or other
  misc_feature (579)..(586): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaagggctggagtgggttggccgcatcaagaggagatatggaaggggaggcgacagactacgctgcacccgtgagaggcagatttaccatgtcaagagatgattcaacaaagtacagtgtatctgacaaatgaacagcctagaacgaccgagacacagcctatttactatagtaacaaatgaaatacggtagggggaacgggggtaaaatcggggaccaaggggaaccctggtccctccgtctcgtcacgccctcgaccgaacgggcccagtccgtcccttcccccgnggcccgtccctgcctcccgagggacncccacccgtccggagacgccacgcggtccggcccgtggggcttcggcccgttgggacaaacggtccttaccgtacccgaacggaagacgtacngggacggccggggtctacgggacgaaacgggccgactaagtaggnnnnnnnn

SEQ ID NO: 316946 - DNA, 605 bp, Homo sapiens
  misc_feature: GZ8MTXP02FZMJ7.19.10.A10.1.454.CMB.2.raw
  modified_base (370)..(370): a, c, t, g, unknown or other
  misc_feature (370)..(370): n is a, c, g, or t
tcagtactctcgtgcacgaccggtgctcgatttagcgtcgatctcagggggggagaggagtcccagccttgggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccggggggtcctgagactctcctgtagaagttatggattcaacttcgctagcggctggctgtgctgggttcgccaggctccgaggggaaggggctgggaggtggggttggccgcatcgaagaggagatagtggaagggggaggcganagactaccgctgcaccgtgagagcagattacatgtacaaagagatgattacaacaaagtacagtgtatctagacaaatagaaacagacctagaaacgaccggaaggaccacacgacctaatttaactaatttagtaaacaaatagaaagtacggtagggggaaacgggggtaaaacgttcgggggaccgaaggggtaacccgtggtaccgtccggtcctcgtacgacgtaccccg

SEQ ID NO: 316947 - DNA, 756 bp, Homo sapiens
  misc_feature: GZ8MTXP02GHHU5.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttaattttaaaaggtgtcctgtgtgaggtgcgcgtggtggagtcgtgggggaggcggtggtccgacggccccggggggtccctggacgtactcctcctagtaagaagttagtggtattactaacttcgctaggcggtctggctggtgcgtcgggttcgccagggcctccggaggggaacggggcgtgggaggttggggtcgccggtcagtacgaaaggaggaagagtagtagggaaggggaggacgagacgaacgtaccggctacgaccgacccggtggaacggacggacgaacgtaactttaaccgaagttcgggtaaactaaaagggagtaattacggtaaacttacaaaacgtaaaagtaacccgtagttaacgttataaccgtagaaaccgtaaaatacggaaacgaagaccgtaaagggaaaccgaaccgggaaacggaaccaaaccggaacttacccgtaaagtttaaccttaagttaacgtaaaacttaaaagtaccggtaagtaaacgggtaggggggaaacggggtaaacgtcggggaaccgtacgggaaccgtcggtacgttccgtaccgtacgtactacggaccc

SEQ ID NO: 316948 - DNA, 731 bp, Homo sapiens
  misc_feature: GZ8MTXP02FKMIJ.19.10.A10.1.454.CMB.2.raw
  modified_base (330)..(330): a, c, t, g, unknown or other
  misc_feature (330)..(330): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttattttaaaaggtgtcctgtgtgaggtgcgcctggtggagtcgtgggggaggcgtgggtccaggcccgggggtccctgagactctcctgtagaagttatggattcaacttcgctagcggctggctgtgcgtgggttcgcaggctcgagggagggctggagtgggtgcgnatcaagagagatagaggaaggggagcgagaacgacgtacccgctcgaccgacccgtggaacgacgggcaaggtaacttttaacccgaagttacgtacgaaaggtaagaagttagtaaacttacgaaactaaaagtacgtaaggtacttaatcgtacgaaactaaagttanaaaccgggggtaanacccggtaagaaacggaaacccggaaggaaaccacgaacgtacccttaaagtttaactaagttacgtaaaactaaaagtaacgtaaagttaaacggggtacgggggggtaaaaacgggggtaaaacggttaccgggggacccggtaaaacgggggtaaccccggttacgggttcccgttaccccgggtacttaccggtaccgacccggtaacccccg

SEQ ID NO: 316949 - DNA, 600 bp, Homo sapiens
  misc_feature: GZ8MTXP02IJR5V.19.10.A10.1.454.CMB.2.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
tcagtactctcgtgcacgaccggtgctcgatttagcgtcgatctcagggggggagaggagtcccagccttggggttccccgagtgttttcgttcagtgatcaggactgaacacgtaggactcaccatggagtttggcctgagttggatttttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgngctggttcgcaggctccgagggaggggctggaggtggggttggccgnatcgaagaggagatagtggaaggggngcgacagactacgctgccacccggtgagagcgagtactttaccatgtacaaganatgattacaataaaagtcagttcgtaatctagacaatagaacagacctagaacgacgagacagancctattatatagaactaatgaaacgtacgggtaggggggaaaacgggtaaggttaccggggacaaacgggggtaacccttcgggtccttacggtccgttaccggacctacgtacccccg

SEQ ID NO: 316950 - DNA, 597 bp, Homo sapiens
  misc_feature: GZ8MTXP02FL2EF.19.10.A10.1.454.CMB.2.raw
  modified_base (422)..(422): a, c, t, g, unknown or other
  misc_feature (422)..(422): n is a, c, g, or t
  modified_base (590)..(591): a, c, t, g, unknown or other
  misc_feature (590)..(591): n is a, c, g, or t
  modified_base (593)..(597): a, c, t, g, unknown or other
  misc_feature (593)..(597): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaaagagatgattcaacaaagtacagtgtatctgcaaatgaacagcctagaagaccgaggacacagccatttactattgtacaaatgaaatacgtagggggaacggggggaaaagttcggggaccgaggggaacccctggtaccctcccgtcgtcgtacacgccctaccaccgaacgggcccctatccttgtcctttcccccnggcccgccctcgcctccgaggaccgccaacccgttccgagagccgacgacgcccgggcctggggccttcgcccgttagggtcgaaacgggccttaccgttaccccacggtaggacgttaaccgtgggacgggccgggcgtacgggcaaacgggggcgaccgagtaagnncnnnnn

SEQ ID NO: 316951 - DNA, 565 bp, Homo sapiens
  misc_feature: GZ8MTXP02GF5CJ.19.10.A10.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcgtggtccaggcccgggggtcctgagactctcctgtagaagttatggattcaacttcgntagcggctggctgtgcgtgggttcncaggctcgagggagggctggagtgggtgccgnatcaagaggagatagtggaagggggagcgacagactacgctagccaccggngacgaggcagtacttaccgatgtacaaagtanatcgaattccaaanaaaggtactagtgttaanctaananaananaanacacagacgacgagacacacactattatatataataatagaagtacggagggaacggggtaacggtacgggacggacggaacgtcgtacgtcgtcgtcgtacgacgcg

SEQ ID NO: 316952 - DNA, 642 bp, Homo sapiens
  misc_feature: GZ8MTXP02GC6WF.19.10.A10.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (606)..(606): a, c, t, g, unknown or other
  misc_feature (606)..(606): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccgtggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgcgtgggtcncgaggctccgagggagggcnggagtgggttggccgcatcgaagaggagatagtagggaaggggaggacgaacgagactacgccgtcgaccacccggtgacgaggcagtacttacagtacgtacaaaggagtatagtaacttacaagaaaacgtagtaaggtgtaactcttaggaactaaaagtgaaaacgtacgaccgtagaaacggaccgaggacaacgacgccttaagtttactagtagtaacaaaagtagaaagtacggggtaagggggaaacggggtaaaggtcggggaccgaacgggttaccgnggttccctacggtcgtcgtacgcgtacccgtacccg

SEQ ID NO: 316953 - DNA, 573 bp, Homo sapiens
  misc_feature: GZ8MTXP02HH3JT.19.10.A10.1.454.CMB.2.raw
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (527)..(527): a, c, t, g, unknown or other
  misc_feature (527)..(527): n is a, c, g, or t
  modified_base (562)..(564): a, c, t, g, unknown or other
  misc_feature (562)..(564): n is a, c, g, or t
  modified_base (566)..(573): a, c, t, g, unknown or other
  misc_feature (566)..(573): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaacgaccgaggacacgagcctatttactattagaacaaatgaagtacggtagggggaaacgggggtaaattcggggaccgacggggtaccctggtccccgtccgtctcgtacacgtccctacccaccgaacgggccctacgtccgtccctcccccgnggcccnccctgcctacgaggcnccaccgcganacgcacgngccgcccgtgggctacggcctgggtaaccaacggtccttacctacccgaagtacgtacgnggacggtacgggctaggggaccaagggcactaagnnngnnnnnnnn

SEQ ID NO: 316954 - DNA, 628 bp, Homo sapiens
  misc_feature: GZ8MTXP02JIZTI.19.10.A10.1.454.CMB.2.raw
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (462)..(462): a, c, t, g, unknown or other
  misc_feature (462)..(462): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcggtggtccgagcccgggggtccctgagactctcctgtagaagttatggattcaacttcgctagcggctggctgtgctgggtcgcaggctccgaggggaagggctggaggtgggttcggccgcatcgaaggaggagatagtgggaaggggagacgacagactaccgcgtgcacccgtgagaggcagtactttaccatgtacaaagnatgaattacaanaaagtacagtagtatctagacaaagtacgaaancgacctagaaacgaccggaagacctaacgacgacccttaaagtttacctagttacgtaaactaaaagttgaaaagttaccgggtaaggggggaaacgggggtaaacgttacgggggaccaacggggtaacccgtggtaccgttccggtctcgtacgactacccccg

SEQ ID NO: 316955 - DNA, 644 bp, Homo sapiens
  misc_feature: GZ8MTXP02IZHS2.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttattttaaaaggtgtcctgtgtgaggtgcgccgtggtggagtcgtgggggaggcgtggtccaggcccgggggtcctgagactctcctgtagaagttatggattcacttcgctagcggctggctgtgcgtgggtccgcgaggctccggaggggaagggcgtgggaggtgggttcggccgcatacgaaggaggagagtagtagggaaggggaggcgagacgactaccgctgccgaccggtgagacgcgagtaacttaccatcgtagaaagagtatagtattacaaacgtaaagtactagttgtaactagtagaaactaaagttagaaactaccggaccgtaggaaccgaacggagaacctagacgtactaaatttactatacgaaactaaagtacgtaaagtacggggtaagggggaacgggtaaacggtcggggaccaacggggtaacccgtgggtccttccggcgtccgtacgaccgtccccg

SEQ ID NO: 316956 - DNA, 705 bp, Homo sapiens
  misc_feature: GZ8MTXP02H9M6K.19.10.A10.1.454.CMB.2.raw
  modified_base (519)..(519): a, c, t, g, unknown or other
  misc_feature (519)..(519): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttaattttaaaaggtgtcctgtgtgaggtgcgcctggtggagtcggtgggggaggcgtgggtccgacggccccggggggtccctggacgactctcctgtagtaagttatggtattactaacttcgctaggcggtcgtggctggtcggcgtgggttccgccgaggtcctaccggaggggaggggcgtgggaggtggggttcggccgacgacgtacgaaaggtaggaagtaagtagtaaggggaaggggagaccggaacgacgactaccgcgtcgccaccggtgacggacggccaaagttacttaaccgaagttcgtaacgaaagtagattagaattacaaacgtaaaagtactaaggttanattacctagactaaaagtaacgaaacacgacgtaagaaacggaccgaaggaacacgactaccttaagtttaactactaagaaactaaagtacgtaaaggtaacgggtaggggggaaaacggggtaacgtacgggggaaccgacgggtaacccgtgtacccggttcgtacgtaccgcgtaactcccg

SEQ ID NO: 316957 - DNA, 670 bp, Homo sapiens
  misc_feature: GZ8MTXP02FX692.19.10.A10.1.454.CMB.2.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (531)..(531): a, c, t, g, unknown or other
  misc_feature (531)..(531): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccgggggtccctggagactctcctgtagaagttatggattcaacttcgctagcggctggctgtgctgggttcgcaggctcgagggagggctggaggtgggtgcgnatcgaagaggagataagnggaagggggagcgagagactaccgcgtgaccaccgtgagacggnagtatttaccagtgacgaaaganatagattacaaataaagtacagtnttatactaganaaanacgtaaacacgcctaggaaacgaccggaaggaaccaacgacgtaccttaaacgttttacgtaaactttacggtaaaanaaaagttacggtaaaaggttaaccggggtaaacgggggggaaaacgggggttaaaaacggttacgggggaacccgtaaacgggggtaaacccgttcggggtaaccgttcccggttacgtaccggtcgaccgtacccccg

SEQ ID NO: 316958 - DNA, 564 bp, Homo sapiens
  misc_feature: GZ8MTXP02FT9DV.19.10.A10.1.454.CMB.2.raw
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (492)..(492): a, c, t, g, unknown or other
  misc_feature (492)..(492): n is a, c, g, or t
tcagtactctcgtgcacgaccggtgctcgatttagcgtcgatctcagggggggagaggagtcccagccttgggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtccctgagactctcctgtagaagttatggattcaacttcgctagcggctggctgtgcgtggtcgcaggctccgagggagggctggagtgggtgccgnatcaagaggagatagtggaaggggagcganagactaccgctcgacaccgtgacgaggcagtactttaccatgtacgaaagagatgattacaaactaaagtacagtataatctgaaanaanagaacacgacgagacgacgacgacacacactattatatataanaatagagtacggtaggggaacgggtaacggtacggacggacggtaacgtcgtcgtcgtcgtcgtcgacgccg

SEQ ID NO: 316959 - DNA, 651 bp, Homo sapiens
  misc_feature: GZ8MTXP02HKN3I.19.10.A10.1.454.CMB.2.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
  modified_base (469)..(469): a, c, t, g, unknown or other
  misc_feature (469)..(469): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttaattttaaaaggtgtcctgtgtgaggtgcgcctggtggagtcgtgggggaggcgtggtccgaggcccgggggtcctgagactctctgtagaagttatggtattcaacttcgctagcggctggctgtgcgtggtcgcaggctcgaggaggntggnggtgggtgcgcatacgaagaggagagtagaggaaggggacgacgagacgactaccgcncgaccaccggtgagagcagtaacttacgatagtacagagatanacttacaaactaaagtcgaagttcgtattcgaagtaacaaagtacgaaaccngtaacccgtaagaaccggaacgtaaggaccaacgacgtaccttaagttaactaattacgtaaaactaaagtacgaaagttacggggaaacggggggtaaacggggtaaaacggtcgggaaccggtaaaccgggggtaaccgtcgggttacccgtacgtccgtacggtccgtaacccgtcccg

SEQ ID NO: 316960 - DNA, 619 bp, Homo sapiens
  misc_feature: GZ8MTXP02HLH19.19.10.A10.1.454.CMB.2.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtggggaggcgtggtccaggcccgggggtcctgagactctcctgtagaagttatggattcaacttcgctagcggctggctgtgcgtggtcncaggctcgagggagggctggagtgggtgccgnatcaagaggagatagtaggaaggggagacgagagactaccgctagccaccgtgagngcagtacttaccatgacaaagtanatgattacaactaaagtcagtatatcgtagacaaagtacgaaactagaccgtaagaaacgaccggtaagaacacgacgtaccttaatttaacgtattaacgtaaactaaaatcggaaaacgttacgggaaggggggtaaaacggggtaaagttccgggggaccgtaaacgggaacccgttggtacccgttcgacgtccgacgtaccgaccccg

SEQ ID NO: 316961 - DNA, 593 bp, Homo sapiens
  misc_feature: GZ8MTXP02GDT21.19.10.A10.1.454.CMB.2.raw
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
  modified_base (586)..(593): a, c, t, g, unknown or other
  misc_feature (586)..(593): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctagacaaatgaacagcctagaagaccgagacacagccatttactattgaacaaatgaatacgtagggggaaacgggggtaaaattggggaccaagggtaaccccgtggtaccctcccgtctcgtcacggccctaccaccgaaacggggccccctagtcccgggtcccttccccccgtgggcccgcccttggccctccgaggcgccaccctccggagacgccacgacgccgggtccctgggtcctgacccgtgggtaccaaacggacccttaccgttccccgaagacgacgtacctggaacgccggggtactcgggacgagggcccganaatggngnnnnnnnn

SEQ ID NO: 316962 - DNA, 623 bp, Homo sapiens
  misc_feature: GZ8MTXP02GT14U.19.10.A10.1.454.CMB.2.raw
  modified_base (296)..(296): a, c, t, g, unknown or other
  misc_feature (296)..(296): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (619)..(619): a, c, t, g, unknown or other
  misc_feature (619)..(619): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcggtggtccaggccccgggggtccctgagactctcctgtagaagttatggattcaacttcgctagcggctggctgtgctgggttcnccaggctccgaggggagggctgggaggtggggttggccgcatcgaaagaggagatagtagggaaggggngacgaacgagactacccgctgaccaccggtgagtaggcaagtactttaccatcgtanaaagngataggtattacaaacgtaaagtacaggtntaatctagactaaanggaanagacctaggacgaacgaggaccacgtagactaatttactattagaactaaatagaaataccggggttagggggaaaccgggggttaatacgggggacccgtaagggaacccgttggtcccgacgtccgttacgaccgaaccncccg

SEQ ID NO: 316963 - DNA, 568 bp, Homo sapiens
  misc_feature: GZ8MTXP02JTDXU.19.10.A10.1.454.CMB.2.raw
  modified_base (305)..(305): a, c, t, g, unknown or other
  misc_feature (305)..(305): n is a, c, g, or t
  modified_base (532)..(532): a, c, t, g, unknown or other
  misc_feature (532)..(532): n is a, c, g, or t
  modified_base (555)..(555): a, c, t, g, unknown or other
  misc_feature (555)..(555): n is a, c, g, or t
  modified_base (558)..(559): a, c, t, g, unknown or other
  misc_feature (558)..(559): n is a, c, g, or t
  modified_base (561)..(568): a, c, t, g, unknown or other
  misc_feature (561)..(568): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctgggagtgggttggccgcatcaagaggagatatggaaggggaggcgacagactacgctgcacccgtgagaggcagatttacatgtacaagagatgattcaacaaagtacagtgtatctagacaaatgaacagcctagaacgaccgaggacacagcctattactatgtaanaatgaagtacggtaggggaacggggtaaatcggggaccgagggaacctggtccctcgtcgtcgtcacgcccaccgaccgacgggccctagttcccgtcccttcccccgtggcccgtccctggccctccgaaggcgcccacccgtccggaagcgaccaccgacggcccggcccgtgggctcgccgtaggtaccgaaaggtccctacgtacccgaggaacgtcgtacgnggcggcggcgcggacgacggcanagnngnnnnnnnn

SEQ ID NO: 316964 - DNA, 688 bp, Homo sapiens
  misc_feature: GZ8MTXP02IPK4M.19.10.A10.1.454.CMB.2.raw
  modified_base (675)..(675): a, c, t, g, unknown or other
  misc_feature (675)..(675): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgaggcccggggggtccctgagactctcctgtagaagttatggattcaacttcgctagcggctggctgtgcgtgggttcgccgaggctccgaaggggaaggggctgggaggtggggttggccggcatcgaaagaggaagataagtaggaaggggaggacgacgaagactacccgcgtcgaccgacccggtggaacggacgggcaaggtaacttttaacccgattcggttaacaaaggggaagtaagttgaactttaaccgaaactaaaaaggttacaaaggttagttaattcctaggaacaaaagttacgaaaaccgtacgacccgttaaggaaacgacccgggaaacggaccaacgacggtaccttaaattttaccgtaattagtaaaactaaagtagaaagtacgggtaagggggaacggggtaaagtcggggacacgggaacgtcggctccgtncgtcacgtacccg

SEQ ID NO: 316965 - DNA, 769 bp, Homo sapiens
  misc_feature: GZ8MTXP02F3A6F.19.10.A10.1.454.CMB.2.raw
  modified_base (317)..(317): a, c, t, g, unknown or other
  misc_feature (317)..(317): n is a, c, g, or t
  modified_base (447)..(447): a, c, t, g, unknown or other
  misc_feature (447)..(447): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtggggaggcgtggtccgaggcccgggggtccctgagactctcctgtagaagttatggtattactaacttcgctagcggctggctgtgcgtggttcgcgaggctcgagggagggntggagtgggttcggaccgcagtacgaaggaggagagtaagaggaaggggaggacgaacgagacgtaccgctacgaccgacccggtggaacggacggcgtaacgtaactttaccgaagttgtaacgaaagngaaatttcgaaatttacgaaaacgttaaaagtaccgtaagtacggttaactacgtaacgaaactaaaagtacgtaaaccgacggtacccgaagggaaaaccggtaacccgggaaagaaccctaacgaacgtaccctttaaaattttaaccaaattttaacggaaaactaaaaggtttacgaaaagggttacggggtaaaaccggggggggtaaaaccgggggtaaaaagggttcccgggggaaccgtaaacccgggggtaaacccttacgggggttaccctcccggggttaccttacccggggaaccaccgtaaccccccgg

SEQ ID NO: 316966 - DNA, 674 bp, Homo sapiens
  misc_feature: GZ8MTXP02IMF39.19.10.A10.1.454.CMB.2.raw
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (478)..(478): a, c, t, g, unknown or other
  misc_feature (478)..(478): n is a, c, g, or t
  modified_base (531)..(531): a, c, t, g, unknown or other
  misc_feature (531)..(531): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttatttaaaaggtgtcctgtgtgaggtgcgccgtggtggagtcgtgggggaggcgtggtccgaggcccgggggtccctggagactctcctgtaagtaagttagtggtattactaacttcgctagcggctggctgtgcgtggtcgcgacggctcgagggaggcgtgggngtgggtgccgnatcaaggaggagagtagtagggaaggggaggacgaacaggacgtaccggcgtacgccgtaccggtgaggaggcagttaacttaaccagttagaacgaaagtagatagtaattacaaacgtaaagtactagtagtactanagaaactaagacgtaacacgtacgaaggaaccgacgggaacaacaccgtaacnccttaatttaactagttaacaaaacgtaaagtcgtaaaaggttaccgggggtaaaggggggaaaaccggggttaaagtccgggggtaaccaacccgggttaaccgtcggtaccctccggtacttaccgacctaacggtccccc

SEQ ID NO: 316967 - DNA, 725 bp, Homo sapiens
  misc_feature: GZ8MTXP02GAGQQ.19.10.A10.1.454.CMB.2.raw
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
tcagtactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaanagcccaccctctcctgcagggccgataagagtgttgacagcacttcttgcctggtaccagcagagacctggccaggcctcccaggcctcctgtttanggtgccgtccaccgagggccacgtggccacgtcccccgagtacggtttccaggttggcagtggtcgtccgtggggacagtacttcacgtctcaccntccagccagaacgtgggacgtacccgtagtaaacgttagttttacgcgttaagttacgttaacttaccgttaacgttacgtaaaccgtaaaccgtaaagttaagttaacggtaagttacggtaaccgttaccgtaaccccgtttcccgggttagggttacgggtaaccgttaacgggttttacgggacccggtaaacgggggtaacccgtaaaaggggttaacggtaaaacggttaaccgtaaaaaccggtaacggttacgggttacgggaccgttacggaaccgtaaaccccgtaatttcccgttcggtttaccgtttaccgtaaccgttttcccccg

SEQ ID NO: 316968 - DNA, 590 bp, Homo sapiens
  misc_feature: GZ8MTXP02FEW02.19.10.A10.1.454.CMB.2.raw
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaaggtgtcctgtgtgaggtgcgcctggtggagtctgggggaggcgtggtccagcccggggggtccctgagactctcctgtagaagttatggattcaacttcgctagcggctggctgtgctgggttcnccaggctccagggaaggggctggagtgggttggccgcatcaagaggagatatgaaagggggagcganagactaccgctgcacccgtgagaggcagatttaccatgtacaaagagatgaattcaacaaagtacagtgtatctgacaaaatgaaacagcctagaagaccgaggaccaacgagcctattaactattagtaacaaaatgaaataacgtaggggggaaaccggggggaaaaagttgggggacccgtaaggggaaaccccgttgggtacctcccgtctaccgtcacgcccc

SEQ ID NO: 316969 - DNA, 722 bp, Homo sapiens
  misc_feature: GZ8MTXP02GFZCK.19.10.A10.1.454.CMB.2.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttaattttaaaaggtgtcctgtgtgaggtgcgcctggtggagtcgtgggggagcgtggtccgaggcccgggggtcctgacgactcctcctgtagtaagttataggattcaacttcgactagcggctggctgtgctgggtcncaggctcgagggagggctggaggtgggtgccgnatcgaagaggagatagngggaaaggggaggacgacgaaggacctacgcgtagccacccggtgaacgagccagtactttacatcgaanaaganatagtactacgaaaataaagtacgtagtactatacgaagaactaaaagacgaaacgacgtaacggtaaagaaaaccgggaaccggaaacggaaacctaaccgaacgttaaccctttaaaagttttaacgtaacgttaaaacgtaaaactaaaacgttaacgggttaaaagggtaaacgggggtaaaggggggggtaaaaacgggggttaaaacggttaccgggggaaccggtaaacccgggttaacccggttcggttacccgttacccggtacgtaccggtaccggaccgtaccccg

SEQ ID NO: 316970 - DNA, 795 bp, Homo sapiens
  misc_feature: GZ8MTXP02IJJI6.19.10.A10.1.454.CMB.2.raw
  modified_base (755)..(755): a, c, t, g, unknown or other
  misc_feature (755)..(755): n is a, c, g, or t
  modified_base (788)..(788): a, c, t, g, unknown or other
  misc_feature (788)..(788): n is a, c, g, or t
  modified_base (790)..(791): a, c, t, g, unknown or other
  misc_feature (790)..(791): n is a, c, g, or t
  modified_base (794)..(794): a, c, t, g, unknown or other
  misc_feature (794)..(794): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccggtgagaggcagtactttaccatgtacaagagtatagtacttacaaacgtaaagtactagtagtactcgtagaactaaatacgaacgacgaccgtaaggaaaccggaaccggaacggaaccaacgacgtaccttaatttacttaattagtaaactaaaagtagtaaacggttacggggtaaggggggtaaacgggggttaaaacggttcggggaaccgtaaaccggggtaacccgttcgggttcccccgttacccgttccgtaccgttaccgaccgtccccctacccgtaaccggggaccggtaccccttacggttccccggttcccccgtttcccccggcgggtcccctacccgtacgcccgtacccggaagggtccacccgacccgtacgaggaccgaccaccggtccgggccccgggttaccccgtgggggtacccctcggtccccggtttagggtaaacccgtaaacccggtttacccttaccccggttacccggaaggaaacggttaacgtcggtaccggggacggggtaccgggtcgaccgggggaaaacncgggggtccctaaaatcggacgcgacgacgcgncnncgng

SEQ ID NO: 316971 - DNA, 630 bp, Homo sapiens
  misc_feature: GZ8MTXP02JAFOG.19.10.A10.1.454.CMB.2.raw
  modified_base (186)..(186): a, c, t, g, unknown or other
  misc_feature (186)..(186): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (478)..(478): a, c, t, g, unknown or other
  misc_feature (478)..(478): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttaattttaaaaggtgtcctgtgtgnggtgcgcctggtggagtcgtggggaggcgtggtccgaggcccgggggtcctgagactctcctgtagaagttatggattcaacttcgctagcggctggctgtgcgtggtcncgagctcgagggagggctggagtgggtcgcgnatcaagnggagatagtaggaaggggngcgacgagactaccgctgccgaccgtgagagcagtaactttacgatcgtacaaagtacgattgaaatttaccaaacgtaaaagtaacgagttacgtaattaccgtagaacaaaagtagaaaacngtacctaggaaacgaccggaagacacgtaacgaccttaatttactaattacgaaataaaagtagaaaagtacggggtaacgggggaaacgggggaaagttacgggggaccgtaagggaaccgtcggtacctccggtctacgtcacgtacccg

SEQ ID NO: 316972 - DNA, 612 bp, Homo sapiens
  misc_feature: GZ8MTXP02JRII3.19.10.A10.1.454.CMB.2.raw
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagtactctcgtgcacgaccggtgctcgatttagcgtcgatctcagggggggagaggagtcccagccttggggttcccgagtgtttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctcgagggagggctggaggtgggtggccgcatcgaagaggagatagtggaaggggaggcgacagactacgctgcaccgtnagngcagacttacatgtanaagnatgtaactcaanaaagtacagtntatctaganaaagtgaacacgctagaacggaccggaagaccaacgacgactaatttacgtaagtacgtaactaaaatgaaaacgttacggggtaaggggggtaaacgggggtaaaaacgttcggggggaacccaagggggtaaacccttcgggtacccgtcccggtacgtccgtacgacggtacccc

SEQ ID NO: 316973 - DNA, 597 bp, Homo sapiens
  misc_feature: GZ8MTXP02F1QVR.19.10.A10.1.454.CMB.2.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (322)..(323): a, c, t, g, unknown or other
  misc_feature (322)..(323): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggagcgtggtccaggcccgggggtcctgagactctcctgtagaagttatggattcaacttcgctagcggctggctgtgctggtcncagctcgagggaggctggagtggtgcgnannaagngagatagnggaaggggagcgacagactacgctgcaccgtgagaggcagtacttacatgtacaaaganactgaatacaaanaaagtcagtgtatcgagaacaagtagaaacagaccagaaacgtaccgaaagacccatacgtaccttaatttaacatttacgaaataaagtaggaaaacttacgggaaggggggtaaacggggtaaaattccgggggaacctaaacgggtaacccgttcgccgttaccgtagtccggtaccacggaccccg

SEQ ID NO: 316974 - DNA, 637 bp, Homo sapiens
  misc_feature: GZ8MTXP02INMRE.19.10.A10.1.454.CMB.2.raw
  modified_base (358)..(358): a, c, t, g, unknown or other
  misc_feature (358)..(358): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccgggggtccctgagactctcctgtagaagttatggattcaacttcgctagcggctggctgtgctgggttcgccaggctccgagggaaggggctggagtggggttggccgcatcaagaggagatagtggaaggggngcgacagacctacgctgcaccgtgagagcagtattaccatgtacaagagatgattacaacaaagtacaagttcgtaatctagacaaagtagaaacagacctagaaacgaccggaaggactacgagcccttaaatttactaagtagtaactaaaagttcgaaaagttaccgggtaaggggggaaaacgggggtaaaaacgttcggggggaaccctaaacgggggtaaacccccgttgggtcccgtttacccggtacgtccggtaacctacggtaaccccc

SEQ ID NO: 316975 - DNA, 586 bp, Homo sapiens
  misc_feature: GZ8MTXP02FJEXO.19.10.A10.1.454.CMB.2.raw
  modified_base (451)..(451): a, c, t, g, unknown or other
  misc_feature (451)..(451): n is a, c, g, or t
  modified_base (579)..(586): a, c, t, g, unknown or other
  misc_feature (579)..(586): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcaacaaagtacagtgtatctgacaaatgaacagcctagaagaccgaggacacagcctatttactattgtaacaaatgaatacgtagggggaacgggggtaaaagttcggggaccaggggaacccctggtccctcccgtactcgtcacgccctaccacccgaacgggcccagtcccggtccttcccccgtgggccctccctgccctccaggcgccctaccnccggaagacgccacgacgcccgggccctggggacctcgcccgttcgggtacaaacggtacctaccgttccccgaaggtacgtacgttacgcggacggccggggctcgggacgaacggcgacagtagcnnnnnnnn

SEQ ID NO: 316976 - DNA, 644 bp, Homo sapiens
  misc_feature: GZ8MTXP02H9X1L.19.10.A10.1.454.CMB.2.raw
  modified_base (224)..(224): a, c, t, g, unknown or other
  misc_feature (224)..(224): n is a, c, g, or t
  modified_base (443)..(443): a, c, t, g, unknown or other
  misc_feature (443)..(443): n is a, c, g, or t
  modified_base (633)..(633): a, c, t, g, unknown or other
  misc_feature (633)..(633): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(644): a, c, t, g, unknown or other
  misc_feature (641)..(644): n is a, c, g, or t
tcagtactctcgtgcacgaccggtgctcgattttagcgtcgatctcaggggtccctgagactctcctgtagaagttatggattcaacttcgctagcggctggctgtgctgggttcgccaggctccgagggaaggggctggagtgggttggccgcatcaagaggagatatggaaggggaggcgacagactacgctgcaccggtgagaggcagtatttaccatgtnaagagatgattacaacaaagtacagtgtatctgacaaatgaaacagcctaggaacgaccgaggacacacgacctatttactattactaacaaaatagaaagtaggtaggggggaaacggggtaaagtcggggaccgaacgggaacccgtggtccccgtccgtcgtcgacacgccctaccgaccgaaccgggtccctacgtccccgttcccttcccccgnggcccctcccgtagccctacgacggtacgccctaacccgtcgagacaccgacgtcggtacccggcccgttagggctccgggtcgtacgggttaaccgaaaaccggtaccttaccgttaccccgaaaggtagacgtaccgtggggacggtcccgggggacgtacggacggaaaccgggccgtaactaaggngcgncnannnn

SEQ ID NO: 316977 - DNA, 648 bp, Homo sapiens
  misc_feature: GZ8MTXP02JU8T2.19.10.A10.1.454.CMB.2.raw
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
  modified_base (504)..(504): a, c, t, g, unknown or other
  misc_feature (504)..(504): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggtattttcctttctgcttaattttaaaaggtgtcctgtgtgaggtgcgcctggtggagtcgtgggggagcgtggtccgaggcccgggggtcctgacgactctcctgtagtaagttatggtattcaacttcgctagcggctggctgtgcgtggtcnccaggctccgagggagggctggaggtgggtcgccgnatacgaagagganatagaggaaggggngcgagagactacgcngcctaccggngagagcagtattaccatcgtacaagataatgaaacttacaaacgtaaagtactagttagttacncgtagaactaaagtacggaaactcgaccgtaaggaacaacgggaagaccaacncgtaacctaattttacctaagttacgtaaaactaaagtaacggaaacggtaacggggtaaggggggtaaaacgggtaaaaggttccgggggaaacgtaaccggggtccgttaggtcccgtacgttcgtaccgacgaccgtaccc

SEQ ID NO: 316978 - DNA, 742 bp, Homo sapiens
  misc_feature: GZ8MTXP02HN3IR.19.10.A10.1.454.CMB.2.raw
  modified_base (338)..(338): a, c, t, g, unknown or other
  misc_feature (338)..(338): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttaattttaaaaggtgtcctgtgtgaggtgcgcctggtggagtcgtgggggaggcggtggtccgaggccccgggggtccctgagactctcctgtagaagttatggattcaacttcgctagcggctggctggtgcgtggttccgcaggctccgaggggagggctggaggtgggtcgccgnagtcgaagaggagatagtagggaaggggaggacgaacgagacgtacccgctcgccacccggtgaggacggctagttaacttaccgattagtaacgaaagtagtatagtaacttaacgaaactaaagttacgaaagttgtaactcgtagaactaaaagtgaaacacgtacccgttaaggaaaccgaaccggaacgtaacgaaccgtaaccgtacctttaaatttaaacctaagtttaagtaaaacctaaaagttaaggtaaaacggttaaacgggggtaaacggggggtaaaacggggggtaaaacggttccgggggaaaaccccggtaaccgggggttaaaccccggttcgggttaacccccggttccggtaccgttccggtaccccgttaccggtaccccccg

SEQ ID NO: 316979 - DNA, 624 bp, Homo sapiens
  misc_feature: GZ8MTXP02G8PT8.19.10.A10.1.454.CMB.2.raw
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (486)..(486): a, c, t, g, unknown or other
  misc_feature (486)..(486): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccaggcccgggggtccctgagactctcctgtagaagttatggattcaacttcgctagcggctggctgtgcgtggtcncaggctccgagggagggctggagtggggttggccggtcatcgaagaggagatagtggaaggggngcganaggactacgctgcaccgtgacgagcagtacttaccatgacaagatatgtaacttcaaacgaaaagtacagttgtaactctagactaaatggaaactagcttagaaacgtaccggaagaaaccanacgacctaatttacaatttagaaactaaaatgtaaacgtaggtacgggggtaaacgggggtaaaagttcgggggacccgtaaagggggaacccgttgggtaacccttcccggtacgttaccgtaccggaactcccccg

SEQ ID NO: 316980 - DNA, 606 bp, Homo sapiens
  misc_feature: GZ8MTXP02F44IJ.19.10.A10.1.454.CMB.2.raw
  modified_base (227)..(227): a, c, t, g, unknown or other
  misc_feature (227)..(227): n is a, c, g, or t
  modified_base (507)..(507): a, c, t, g, unknown or other
  misc_feature (507)..(507): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(606): a, c, t, g, unknown or other
  misc_feature (599)..(606): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtacaaganatgattcaacaaagtacagtgtatctagcaaatgaacagcctagaacgaccgaggacacagcctaatttactattagtaacaaatggaactaggtaggggggaaacgggggtaaaagtcgggggaccaacggggtaacctggtacccctccgtcctcgaccgacgccctcccgacgaaacggccctagtccccgttccttacccccgcggcccgtcccgtcgccgtcccgacggacgccctaaccgccgacgacgcaccgcggtcccggcccgtggtccncggtcccttagggacctaaacggtcccttaccgtcccgaacgtagaccgtagtcggacgccgggacctggacgaacggccgtacganagngnnnnnnnn

SEQ ID NO: 316981 - DNA, 614 bp, Homo sapiens
  misc_feature: GZ8MTXP02H8662.19.10.A10.1.454.CMB.2.raw
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
  modified_base (470)..(470): a, c, t, g, unknown or other
  misc_feature (470)..(470): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtggggagcgtggtccaggcccgggggcctgagactctcctgtagaagttatggattcaacttcgcttaggcggctggctgtgcgtgggtcgccgaggctcgagggagggctggaggtgggtggccgcatacaaggaganatagtggaaggggagcgaanaggactaccgcgtcgccgaccgtgaggagcagtatttaaccagtacgtacaaagtgaatagattacaaacaaaagtcaggtancgttacagacaaaagtacgaacgancgtaaggaacgacggagtaacaacgatacctaagttactagtttanaaacgtaanaacgtagtaacggtacgggggaaacggggtaaagtccgggggactacggggaacccgtggtacccgtacgtcgttaccgctacgccccg

SEQ ID NO: 316982 - DNA, 726 bp, Homo sapiens
  misc_feature: GZ8MTXP02I9KC1.19.10.A10.1.454.CMB.2.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcggtggtccgaggcccgggggtcctgagactctctgtagaagttatggtatacacttcgctagcggctggctgtgcgtggtcgcgagcgtacgagggagggcgtggngtgggtggccgnatacgaaggaggtagagtaggtaggaagggggacgtacgacgacgactacccgcgtgaccgtaccggtggacggtacggcgtaagtaacttaccgtataggtaacgaaagataaacgtagaacttaacaaacgttaaagtaacgtaagttcgttaaactcgtaacgtaaacgtaaaagtacgaaaacgtaccgaaccggtagaaaccgaaccggggtaacacgaaccgtaacgtaaccttaagtttaacgtaatttaaccgtaaaagtaaaagttacgaaacggttacgggggtaaaggggggaaaacccgggggtaagggttaaccgggggaaccggttaaccggggaaccgttacgggttaccgtccggtacgtccggtacgtaccgtacccgg

SEQ ID NO: 316983 - DNA, 693 bp, Homo sapiens
  misc_feature: GZ8MTXP02G8TXD.19.10.A10.1.454.CMB.2.raw
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
  modified_base (507)..(507): a, c, t, g, unknown or other
  misc_feature (507)..(507): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggccccgggggtccctgacgactcctcctgtagaagttatggatttaccaacttcgctaggcggtctggtctgtgcgttcgggttcgaccgaggcctccggaggggaaggggcgtagggaggtgggtcggccgcancgtaaagaggagatagtggtaaggggacgacgacgagtaacgtacccgcgtcgccgaccccggtaggaacggacgggctaaaggttaactttaccaagttcggaanaaaggtagagttactattacaacgtaaaagtacgtagtcgtaancttaagactaaaatacgaagactctaaggaaacgaaccgagaacctcggtaacaccttaattaatactaagtaactaaaagaggaaacgttacggggaagggggtaaaacgggggtaaaacgtcgggggaaccgttaaccggggaaccttggtcccgtaccggtctcccgtacggacctaaccccg

SEQ ID NO: 316984 - DNA, 634 bp, Homo sapiens
  misc_feature: GZ8MTXP02G77U8.19.10.A10.1.454.CMB.2.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (433)..(433): a, c, t, g, unknown or other
  misc_feature (433)..(433): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccgacggcccgggggtccctgacgactctcctgtagaagttatggattcaacttcgctagcgctggctgtgctggtcgcngctcgaggaggctggngtgggtcgccgnatacgaagaggagatacgaggaaggggaggcgacagacacccgcgtgcccgaccggtgacggaggcgaagtacttaaccagtacgtacgaaagagtattgtaacttanaaaccgtaaaagtactaagttgtaatccgtagactaaagtacgaaacgtacgtacctaaggaaaccgacgggaacgtaaccacgacgttactagtttacattagaaactaaatcggaaatacgggtaagggggaaacgggtaaacgtcgggacgaaacggtaaccgtcgtaccgttacgccgtacgtaccgacgtaccccg

SEQ ID NO: 316985 - DNA, 678 bp, Homo sapiens
  misc_feature: GZ8MTXP02FOCF5.19.10.A10.1.454.CMB.2.raw
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggatttttcctttctgcttaattttaaaaggtgtcctgtgtgaggtgcgcctggtggagtcgtgggggaggcgtggtccgaggccccgggggtccctgagactctcctgtagtaagttatggtattcaacttcgctaggcggtctggctggtgcgtgggttcgcgaggctccgagggaggcgtggaggtgggtgccgcagtacaagaggagatagtaggaaggggagcgacgagactaccgcgtcgcgaccgtgagacgcagtattaccagtacgtacgaaagagtatagtatacaaagtaaatacgagtgtagctagaacaagtagaaactgactaagaacggaaccggtaagaaccaacacgtacccttaaatttactaagttaagtaaaacgtaaaagtacgtaaaaggttaccgggggtaaaggggggtaaaaacgggggtaaacgttaccggggggaccctaaaacgggggtaaccccgtttacgggtcccgttacccgggttcgttaccggtacccaacggtacccccg

SEQ ID NO: 316986 - DNA, 658 bp, Homo sapiens
  misc_feature: GZ8MTXP02GSZT6.19.10.A10.1.454.CMB.2.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (451)..(451): a, c, t, g, unknown or other
  misc_feature (451)..(451): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtgggggaggcgtggtccgaggcccgggggtccctgagactctcctgtagaagttatggattcaacttcgctagcggctggctgtgcgtggtcgcaggctccgagggaggctggngtggtgcgnancaagngagatagtggaaggggngacganagactacgctgccgaccgtgaggaggcagtacttaccatcgtacgaaagagtatagtaattacgaaataaagtactaagttgtaatacgtagaanaaagtagaaacgacgtaccgtaagaaccgacggaacgaaccacgacgtaccttaaatttacttaagttagtaaaacgtaaaagttacggtaaacggttaacggggtaaaggggggtaaacgggggtaaaagggttaccggggaccggtaaaacggggtaacccgttaggttcccgtaccggttcgtaccggtacgtaccgtaccccg

SEQ ID NO: 316987 - DNA, 676 bp, Homo sapiens
  misc_feature: GZ8MTXP02HIU8C.19.10.A10.1.454.CMB.2.raw
  modified_base (346)..(346): a, c, t, g, unknown or other
  misc_feature (346)..(346): n is a, c, g, or t
tcagtactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgcttattttaaaaggtgtcctgtgtgaggtgcgcctggtggagtcgtggggaggcgtggtccaggcccgggggtccctgagactctcctgtagtaagttatggattcaacttcgctaggcggctggctgtgcgtggttcgccaggctccgagggaagggctggaggtgggtggccgcatcaaagagganatagaggaaggggaggacgaacgagactacccgctcgcccaccggtagacggaggcaagtaactttaccgatcgtacaaagtagatagaaacttcgaaaacgaaaagttaccgtaagttacgtaattaccgtagaaacctaaaagttacgaaaacacggtaacccgtaagaaaaccgggaacccgaaagtacaacgacgtaaccttagtttaaacctagttagtaaaacaaaagttcgaaagttaccgggaggggggaaaaccggtaaagggtaccgggacgaaaacgggtaaccccgtggtcccgactcgtaccgtacgaactcccccg

SEQ ID NO: 316988 - DNA, 636 bp, Homo sapiens
  misc_feature: GZ8MTXP02FSLB1.19.10.A10.1.454.CMB.2.raw
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
tcagtactctcgtgcacgaccggtgctcgatttagcgtcgatctcaggggggagctgctcagttaggacccagagggaaccatggaaaccccagcgcagcttctcttcctcctgctactctggctcccagatagcaccggagtaaattttcttgacgcagtctccaggcaccctgtctttgaccccgtaggggaaagagcccaccctctcctgcagggccgataagagtgttagacagctaccttcttgcctggtacngcagagacctggcagcctccgaggtctctgttanggtnccgtacaccgacggccacgtggcactccccgagtaggtcagtggctaggngtggtcgtgggacagtacttacactaccacacgatcgaagtacaagacgtggacgtactagaacgttattcgctagtagtacttacgtagtacaaagattagacgtagtacggtaacggttcctaacccggttcggttacggggtcgtaaacgttacgggtttacggggaaccggtaacgggggtaacggttaaacgggtttaaggaaacggttaaccgtaaaacggtacgttacggtgtacgtacgaccgtaacccgtaattcgtacgtcttaccacttcccgtacccg

SEQ ID NO: 316989 - DNA, 722 bp, Homo sapiens
  misc_feature: GZ8MTXP02FG4VU.19.10.A10.1.454.CMB.2.raw
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (504)..(504): a, c, t, g, unknown or other
  misc_feature (504)..(504): n is a, c, g, or t
tcagtactctcgtgcacgaccggtgctcgattttagcgtcgatctcagggggggagaggagtcccagccttggggttcccgagtgttttcgttcagtgatcaggactgaacacgtaggactcaccatggagtttggcctgagttggtatttttcctttctgcttattttaaaaggtgtcctgtgtgaggtgcgcctggtggagtcgtgggggaggcgtggtccaggcccgggggtccctgagactctcctgtagaagttatggattcaacttcgctagcggctggctgtgcgtggttcgcaggctaccgagggaaggggctggaggtggggtggccgcatacgaagagganataagtggaaggggagcgagagacaccgctgcncccgtgagngnagaacttacatgtacaaagagactagtaacttacaaaataagtacaggtatactgtagaactaaaatcgaaacgacgttaccgaacggaaaacggaaaccccgggtaanaaaccgtaaaccgacgttaacctttaagtttaacctaagtttaacgtaaaaacgtaaaagttaaacggtaaacgggtttaaacgggggtaaacgggggggtaaaaccgggggttaaaacgggttacccgggggaaacccggttaaaccgggggtaacccccgtttcgggtttaccccgttcccggttaccgtacccggtacccgtaacccgtcccccg

SEQ ID NO: 316990 - DNA, 629 bp, Homo sapiens
  misc_feature: GZ8MTXP02I1RVK.19.10.A10.1.454.CMB.2.raw
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagtactctcgtgcacgaccggtgctcgatttagcgtcgatctcagggggggagaggagtcccagccttggggttcccgagtgtttttcgttcagtgatcaggactgaacacgtaggactcaccatggagtttggcctgagttggattttcctttctgcttattttaaaaggtgtcctgtgtgaggtgcgcctggtggagtctgggggagcgtggtccgagcccgggggtcctgagactctcctgtagaagttatggattcaacttcgcttagcggctggctgtgctggttcgccaggctccgagggagggctggagtggggttgccgnatcgaagaggagatagtggaaggggagacgacagtactaccgctgcccaccgtgagagcagtatttaccatgtanaagngatgattcaaanaaagtnagttgtaatctagacaaagtacgaaactcggacttaggaacgtaaccggagaaccgacaagtccctaagtttacctagttacgtaaacgtaaaattgaaactacggtaagggggtaacggggtaaaacgttcgggggaccgtaaacggggtaacccgttggggtaccgttaccccggtacttacggttaccgacggtacccc

SEQ ID NO: 316991 - DNA, 705 bp, Homo sapiens
  misc_feature: GZ8MTXP02GMJQH.19.10.A10.1.454.CMB.2.raw
  modified_base (290)..(290): a, c, t, g, unknown or other
  misc_feature (290)..(290): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
tcagtactctcgtgcacgaccggtgctcgatttagcgtcgatctcaggggggagaggagtcccagccttggggttcccgagtgttttcgttcagtgatcaggactgaacacgtaggactcaccatggagtttggcctgagttggattttccttctgcttattttaaaaggtgtcctgtgtgaggtgcgcctggtggagtcgtggggaggcgtggtccaggcccgggggtcctgagactctctgtagaagttatggattcaacttcgctagcggctggctgtgcgtggtcncgaggctcgagggagggcgtggaggtgggtgccgcagtacgaaaggaggagaagtagtacgggaaagggggacgacgacgaaacggacctaccgcgtacgaccgtaacccggtggaacggacgggccgaaggtaactttaaccgagttacgtaacgaaagaataatagtaacttaacgaaaactaaaagtcagtagtacncgtaaanaaacgtaaagtacgaaacgacgtacgaaggaaccgaaccggtaagaaccacgaacgtaacttaagttaacgtaagtacgtaaaactaaagtacggtaaaggtaacggggtaaacgggggaaaacggggttaaacgtacggggaacccgtaaaccggggtaaccgttcgggtacccgtaccggtcgtaccggtacccgaccgtaacccg

SEQ ID NO: 316992 - DNA, 673 bp, Homo sapiens
  misc_feature: GZ8MTXP02GGFB4.19.10.A10.1.454.CMB.2.raw
  modified_base (176)..(176): a, c, t, g, unknown or other
  misc_feature (176)..(176): n is a, c, g, or t
  modified_base (241)..(241): a, c, t, g, unknown or other
  misc_feature (241)..(241): n is a, c, g, or t
  modified_base (462)..(462): a, c, t, g, unknown or other
  misc_feature (462)..(462): n is a, c, g, or t
  modified_base (672)..(672): a, c, t, g, unknown or other
  misc_feature (672)..(672): n is a, c, g, or t
tcagtactctcgtgcacgaccggtgctcgatttagcgtcgatctcaggggtccctgagactctcctgtagaagttatggattcaacttcgctagcggctggctgtgctgggttcgccaggctccgagggaagggctggagtgggttggcgcatcaagaggagatagtggaaggggnggcgacagactacgctgcaccgtgagaggcagtattacatgtcaagagatgattcaataaagtanagtagtatctagacaaatgaacagcgtagaacgaccgaggaccacgaacgccttaatttactaagttacgtaactaaatagtaaagtacgggtagggggaaacggggtaaagtcgggaccgacggtaacccgtggtcccctccgtctcgtacacgcctaccaccgacggtacccagttcccgtcccttccccgacgggccctccctgaccgtcgacggacncccttaacccgcgaagaccgacgaccgacggccccgggacccgttggggcccttaaggcccgttggggtaaaccctaaaccggtccctttaacccgttaccccgaaaggtaccgtaaacggtacgggacgggtaccggggtacgacggaaccggtaaaacgggccccgaaagaacggtcgacgtaacgacgacgtacgagtacgcgacgng

SEQ ID NO: 316993 - DNA, 494 bp, Homo sapiens
  misc_feature: GZ8MTXP01EB148.13.46.E02.1.454.CMB.2.raw
  modified_base (464)..(464): a, c, t, g, unknown or other
  misc_feature (464)..(464): n is a, c, g, or t
  modified_base (483)..(494): a, c, t, g, unknown or other
  misc_feature (483)..(494): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacgtttggagtggtgcgctcgaccccgtgggccccggaacctggtcaccgtctcctcacgccctccaccgacggcccagtccggtccttccccctggccaccccttcctccaaagcgccccacctcggtgggggccacgaacggcccggcccgtggggcctcggtccgtgggtacgaagggtaccttacgttcctaaggtacgtgacgtggacggcgggtcgnggacgaacggcagagtggnnnnnnnnnnnn

SEQ ID NO: 316994 - DNA, 470 bp, Homo sapiens
  misc_feature: GZ8MTXP01C0TCH.13.46.E02.1.454.CMB.2.raw
  modified_base (463)..(470): a, c, t, g, unknown or other
  misc_feature (463)..(470): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgatgggccacgaccacgtactttggagtggtgcgctcgaccccgtggggccccggaacctggccaccgtcctcctcacgcctccaccaacgggccccatccggtccttcccccgtggccacccctcctccaagcgcccacctcgtcgggggccacgaacgccggcccgtgggcctggccctggtacaacggctacttcgtagtcgtgactgagcgggctggacgaaggcgacagtaggnnnnnnnn

SEQ ID NO: 316995 - DNA, 516 bp, Homo sapiens
  misc_feature: GZ8MTXP01ED946.13.46.E02.1.454.CMB.2.raw
  modified_base (499)..(516): a, c, t, g, unknown or other
  misc_feature (499)..(516): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgatgggccacgaccacgtacttttggagtggtgcgctccgaccccgtggggccccggaacccgtggtccaccgtctcctcacgccctccaccgaacgggccccagtccggtccttccccccgtggccctacccctcctaccaagcgccccaccgtcgcgggggccaccgaacggcccggcccgtgggccgtcgccgtcggtacgaacgggtaccttacgttccgtaggtacgtgacgtggacggcgggcgtcgggacgaagggcgacagtagggnnnnnnnnnnnnnnnnnn

SEQ ID NO: 316996 - DNA, 495 bp, Homo sapiens
  misc_feature: GZ8MTXP01BN474.13.46.E02.1.454.CMB.2.raw
  modified_base (265)..(265): a, c, t, g, unknown or other
  misc_feature (265)..(265): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (466)..(495): a, c, t, g, unknown or other
  misc_feature (466)..(495): n is a, c, g, or t
tcagtcacgtactacacgaccggtgctcgatttagactcatctacagggaaaggggcctggagtgggtctcaggtatttatgggaacagtgaaagaatagggtatgcggactctgtgaagggccgattcaccatctccagagacaacgccaagaactcccttctttttgacaaatgaacagtctagaaaactgaggactcggccttatattactgtctacaaagaaagtaataagtgggggtctcgactacgtggggccagggcnccctggccaccgtctcctcagccctccacgaaggccccatcggtcctccccgnggccncccctncctccgaggcgccaccgtccgagacgcacacgccggcccgtggggctcggtcgtacgtccccgaaggtactttcctacccgtagtaaccgtgcgtggaacgggccccgggtancggggcaacggggtcanagagngnnnnnnnnnnnnnnnnnnnnnnnnnnnnnn

SEQ ID NO: 316997 - DNA, 430 bp, Homo sapiens
  misc_feature: GZ8MTXP02IXQKX.13.46.E02.1.454.CMB.2.raw
  modified_base (423)..(430): a, c, t, g, unknown or other
  misc_feature (423)..(430): n is a, c, g, or t
tcagtcacgtactacacgaccggtgctcgatttagactcatctacagggaaagggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatattttttgacttctggggccaggaaccctggccaccgtctcctcagcttccaccaaggcccatcggtcttccccctggcgccctgctccacggagcacctctggggcacgagcggccctgggctgcctggtcaaggctacttcctagtacgtgactgagcgggctggccaaggcgcatagnnnnnnnn

SEQ ID NO: 316998 - DNA, 560 bp, Homo sapiens
  misc_feature: GZ8MTXP02IZ5AM.13.46.E02.1.454.CMB.2.raw
  modified_base (534)..(560): a, c, t, g, unknown or other
  misc_feature (534)..(560): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacttttggagtggtgcgctccgaccccgtggggccccggaacctggtccaccgtcctccctcacgccctccaccgaacgggccccagtcccggttcccttcccccccgtggacccaccccctcctacccgaaagacgcccctacccgtccggtcgggggaccaaccgacggtcccgggcccgtgggggcctcggccctggggtaccaaagggtacccttaaccgttcccgtaacggttaccgtcgaaccgttggacggccggggtcgtgggaccgaaagggccgaccaagtgnnnnnnnnnnnnnnnnnnnnnnnnnnn

SEQ ID NO: 316999 - DNA, 482 bp, Homo sapiens
  misc_feature: GZ8MTXP02FPP11.13.46.E02.1.454.CMB.2.raw
  modified_base (469)..(482): a, c, t, g, unknown or other
  misc_feature (469)..(482): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccccgtggggccccggaccctggtccaccgtctcctcacgcctccaccaacggccccatccggtccttccccctcggccacccctcctccaaagacgccccacctcgtcggggcacgacgccggcccgtgggctcgcctggtacaagggacctacttccgtagtacgtcgctgacggccgggcgtcggcgaaacggcgacgagtagnnnnnnnnnnnnnn

SEQ ID NO: 317000 - DNA, 400 bp, Homo sapiens
  misc_feature: GZ8MTXP02IEC58.13.46.E02.1.454.CMB.2.raw
  modified_base (373)..(373): a, c, t, g, unknown or other
  misc_feature (373)..(373): n is a, c, g, or t
  modified_base (395)..(400): a, c, t, g, unknown or other
  misc_feature (395)..(400): n is a, c, g, or t
tcagtcacgtactacacgaccggtgctcgatttagactcatctacagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctgggggccaagggccacggtcaccgtctcctcagcctccaccaagggcccatcggtcttccccctggcgccctgctccaggagcacctccgagagcacagcggccctgggctgcctggtcaaggcctactcctagtacgtgactgngcgggctggcaaggcgcatagnnnnnn

SEQ ID NO: 317001 - DNA, 529 bp, Homo sapiens
  misc_feature: GZ8MTXP02GKJ6Y.13.46.E02.1.454.CMB.2.raw
  modified_base (512)..(529): a, c, t, g, unknown or other
  misc_feature (512)..(529): n is a, c, g, or t
tcagtcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgagtgggccacgaccacgtacttttggagtggtgcgctccgaccccgtggggccccggaaccctggtccaccgtcctcctcacgccctcccaccgaacggcccagtccggtccccttccccccgcggcccaccccctcctacccgaaacgacgcccctacccgtccggtcgggggaccacgacggcccgggcccgtcggggcctcggccgtcgggtacgaacgggtaccttaccgttccgtaaggtaccgtgaccgtggacggcggggctgggcgagggccacatagnnnnnnnnnnnnnnnnnn

SEQ ID NO: 317002 - DNA, 509 bp, Homo sapiens
  misc_feature: GZ8MTXP01B79LR.9.21.B10.1.454.CMB.2.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattgggcattataaccttgtctcctgatcaacaacgcccagacaaacgccccanactctaattangagtcactaagcgccctgagggtttcnggtcgcttcctctgcctcaagtctgcaacacggcctccctgacaatctctggctccagtctgacgacgagctgattatactgcagctcatatgctagtttcggttccttntttcaaagntaagttcggcggaggacccagggcttcgaccgttcctgagtcacgccaaggtccttcggcccccg

SEQ ID NO: 317003 - DNA, 561 bp, Homo sapiens
  misc_feature: GZ8MTXP01EEM7Q.9.21.B10.1.454.CMB.2.raw
  modified_base (433)..(433): a, c, t, g, unknown or other
  misc_feature (433)..(433): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagagggagggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatcctcctgcactcggacccacactgatattgggcattataactgtctctgatcaacacgccagacaaacgccccacactcttaatttatagagtacactaagcccggtccctcgtagggtttctggtcgtcttcctctgccctccaacgtctggcaacaccggccctccctgacaatctctggctccagtctgacgacgagctgattatactgcagtctcatangcgtagtttcggttcctcttttacaagtnttaacgttcgggacgggacgggacccgaggggtcttacggacccgttcccgtggtaacggtccaacggccccgaaacgggtcccttccggtcccccccg

SEQ ID NO: 317004 - DNA, 577 bp, Homo sapiens
  misc_feature: GZ8MTXP01AYYN8.9.21.B10.1.454.CMB.2.raw
  modified_base (380)..(380): a, c, t, g, unknown or other
  misc_feature (380)..(380): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtactacaacaccgccagaacaaaccgccccacactacttaatttatgagtacactaacgccgccctcgtagggtttctggtcgtcttcctctgccctcaagtctcgcacaccgcctccngacatctctggctcagtctgacgacgagctgattatactgctagtctacatatcgctagtttcgttccttacttacgaaagttagttaacggtttccgggacggggttaaacggaccgaacggtccttacggttacccgttcccgttaaggacgttccgaccggaccccgaacggtcccgttcccggtcccccccgg

SEQ ID NO: 317005 - DNA, 521 bp, Homo sapiens
  misc_feature: GZ8MTXP01A7U7Z.9.21.B10.1.454.CMB.2.raw
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctcctgatcaacaacgccagacaaacgcccccacactacttaatttangaggtcactaagccgccctcgtaggggtttctggtcgcttcctctgcctccaagtctggcaacacgcctcctgacatctcnggctcagtctgacgacgtagctgattatactgcagctcatatgctagtttcgttcctntttcaaagtctaagttcgggagggacggccgaggcttggcccttcgtgacgtcacgcccaagggccttccggcccccg

SEQ ID NO: 317006 - DNA, 521 bp, Homo sapiens
  misc_feature: GZ8MTXP01CRSLV.9.21.B10.1.454.CMB.2.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
tcagtgatacgtctcacgaccggtgctcgatttagtgtcgtcgcaagagaggaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataacttgtctctgatcaacaacgccagacaaacgcccccacactcttaatttangagtcactaagcgccctnagggtttctggtcgcttcctctgcctccaagtctggcaacacggcctcctgacaatctctggctcagtctgacgacgagctgattatactgcagctcatatgctagtttcgtccttctttacaagtataagttcgggcggtagggccgtaagggcttcggacccgttcctgacgtcaacgcccgaagggtcccttcgtccccccg

SEQ ID NO: 317007 - DNA, 496 bp, Homo sapiens
  misc_feature: GZ8MTXP01A9YWX.9.21.B10.1.454.CMB.2.raw
  modified_base (289)..(289): a, c, t, g, unknown or other
  misc_feature (289)..(289): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
tcagtgatacgtctcacgaccggtgctcgatttagtgtcgtcgcaagagaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagcggccctcagggtttctggtcgcttcctctgcctccaagtctggcaacacggcctcctgacaatctctggctcagtctgacgacgagctgattatactgcagctcatatgcagttgtcctctttcaagntaagttcggnggaggccaggcttgccgttctgngtcagccaggcttcgccccg

SEQ ID NO: 317008 - DNA, 544 bp, Homo sapiens
  misc_feature: GZ8MTXP01DJB5L.9.21.B10.1.454.CMB.2.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtancaacaacgcccagacaaacgcccccanactcttaatttangagtcactaagcggccctcgagggggtttctggtcncttctcctgcctcaagtctagcaacacgcctccctgacatctctggctcagtctgacgacgagctagattatactgcaggctcatangctagttcgttcctctttacaagtnttagttcgggcggttagggacccgaggtccgtcgaacccgttccgttaggtaagtccgaacggcccccgaaggttcccgtccgttccccccgttcgg

SEQ ID NO: 317009 - DNA, 576 bp, Homo sapiens
  misc_feature: GZ8MTXP01BPP1C.9.21.B10.1.454.CMB.2.raw
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctctgcactcgacccacactgatattggctattataaccttgtctctgatacaacacgccagacaacgccccacactacttaattatgaggtacacgtaacgccggtccctcgtagggtttctcggtcgtcttcctctcgccctaccaagtctggccaacgaccggccctcccagactaactcctcgtgggcctcgagtctagacgacgaggtctagtattatactgcagtctactagtatcgtacttggtttcggttcccttacgttacgaagtacgttaacggttcgggacgggtacggaccgtaggtcgttccgttaccgttctgggtactccgaccgtcccgacggtcccgttccgtcccccg

SEQ ID NO: 317010 - DNA, 522 bp, Homo sapiens
  misc_feature: GZ8MTXP01EVBHI.9.21.B10.1.454.CMB.2.raw
  modified_base (291)..(291): a, c, t, g, unknown or other
  misc_feature (291)..(291): n is a, c, g, or t
  modified_base (492)..(492): a, c, t, g, unknown or other
  misc_feature (492)..(492): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctacgtgtctgggtctcctggacagtcgatcaccatctcctgcactggacccacactgatattgggcattataaccttgtctcctggatcaacaacgcccagacaaacgcccccanactcttaattatgaggtcactaagcgccctcgagggtttctggtcgcttcctctgcctcaagtctgcaacacggcctccctgacatctctggctccagtctgacgacgaggctagacttatactgcagctacatatgctagtttcgttcctgtttacaagtataagttcgggcgggaggccgaaggtcttcgaccgttccngacgtcgacgcccagggtccttcgcccccg

SEQ ID NO: 317011 - DNA, 509 bp, Homo sapiens
  misc_feature: GZ8MTXP01DY458.9.21.B10.1.454.CMB.2.raw
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagaggaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactggacccacactgatattgggcattataaccttgtctcctggatcaacaacgccagacaaacgccccacactcttaatttatgagtcactaagcggaccctcgagggtttctggtcgcttcctctgcctcaagtctggcaaacacggcctcctgacaatctctggctccagtctgacgacgagctgattatactgcagctcatatgctagttggtcctcgtttanagtntgtcggcggaggacgaggtcttcgccgttcgtgacgtcgacgcccgagtccgttccgtccccg

SEQ ID NO: 317012 - DNA, 516 bp, Homo sapiens
  misc_feature: GZ8MTXP01DZ4RU.9.21.B10.1.454.CMB.2.raw
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactggacccacactgatatgggcattataacttgtctctgatcaacaacgcccagacaaacgccccacactcttaatttatgagtcactaagcggccctcgtaggggtttctggtcgcttcctctgcctcaagtctgcaacaccggcctccctgactatctctggctccgatctgacgtacgaggctgattatactgcagctacatatgctagttgttcctnttacaagtntaagttcggcggtacgggacagggcttggcccgttcctgagtccacgcccaggtccttccgtcccccg

SEQ ID NO: 317013 - DNA, 554 bp, Homo sapiens
  misc_feature: GZ8MTXP01CC0IC.9.21.B10.1.454.CMB.2.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (417)..(417): a, c, t, g, unknown or other
  misc_feature (417)..(417): n is a, c, g, or t
tcagtgatacgtctcacgaccggtgctcgatttagtgtcgtcgcaagagaggagggggggtcacaagaggcagcgctctcgggacgtctccaccatggcctggactctgctgctcctcaccctcctcactcaggacacagggtcctgggccctgtctgccctgactcagcctgcctccgtgtctgggtctcctggacagtcgatcaccatctcctgcactgacccacactgatattgggcattataacttgtctctgatcaacaacgccagacaaacgccccanactctaattangagtcactaagcgcctcgtagggtttctggtcgtctttcctctgtccctccaagtctggcaacacgccctccctgacaatctcgtggactccagtctgaacgacgagctgattatactcganagctatatatgcgttagtttcggttcctattttcaaaggtatttcggttacgggccgggtaaggggaaccctggggccttacggttccgttccctgggaacgtcacggccccgaagggtcccttccggtcccccccg

SEQ ID NO: 317014 - DNA, 582 bp, Homo sapiens
  misc_feature: GZ8MTXP01D8FI8.9.21.B10.1.454.CMB.2.raw
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacaacgccagacaaacgccccacactcttaattatgagtacactaagccggccctcgagggtttctggtcgcttcctctgcctcaagtctggcaacacggcctccctgacatctctggctcagtctgacgacgagctgattattacngcagctnatatgcgtagtttcggttccttactttacaaacgtgttaacgtttcggggacgggtaacggggaccccgagggtacgttccggttaacccggttccccgttaaggaacgttcccgaaccggtccccgaaacggggtccccttcccgggttccccccccgg

SEQ ID NO: 317015 - DNA, 690 bp, Homo sapiens
  misc_feature: GZ8MTXP01BXEKW.9.21.B10.1.454.CMB.2.raw
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgccctcgtgtcgtggtcctcgtgactgtcgatccacctatcctcctgacctacgtaccgaaccccacactagtattagtggactattaacttaaccttgtctcgtagtactacaacaccnccagaacaaccgccccatactactttaattnagtacgtacactacgcccgtcctaggtagggtttctggtctccttcctcgtcgccctaccgtaagttccgtacggaaccaaccgacccggtccctacccgtacgaactacgttcctcggtcggtccctacgtacgttcgacggaaccggacggtacgtctagttaactttaacgttacgtcggctaacggtcctactaattcgtcgtaccgttaggttttcccggtttcctttccgttaaacgtaaagttaacgttaacgggttcgggggaccggggaaacgggttaccgtacggtccgttaccggttaccccgttgtaaggacgtaaccgaccgacccggaacggtccccgttcccgggtcccccg

SEQ ID NO: 317016 - DNA, 602 bp, Homo sapiens
  misc_feature: GZ8MTXP01DEBMH.9.21.B10.1.454.CMB.2.raw
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcatccaccctcctcactcaggacacagggtcctgggccctgtctgccctgactcagcctgcctcgtgtctgggtctcctggacagtcatcaccatctcctgcactggaaccagcagtgatgttgggagttatgtaccttgtctcctggtaaccaaacacgaccaaccccgaaggaccaaaaccgaccccccaaacttacatactaatttaagtgaacggtacaactaaacggccggtccccttagtaaggggttttcctatttccgctttctctcggaccttacctaagtcctagaaacaacccgaccggccctccctagactaatccgtcngggcctccgaggctgacggacgagctagatttaattcngtctgcctanagtatcgntagatgngaactcttccggtaggttacgtcgggacggaacgggccgttaacggtcgtaacccggttcccgtagggtccaccggtcccgaacgggtcccc

SEQ ID NO: 317017 - DNA, 534 bp, Homo sapiens
  misc_feature: GZ8MTXP01CO27G.9.21.B10.1.454.CMB.2.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatattgggctattataaccttgtctcctgtatcaacaacgcccagacaacgccccanactcttaattatgagtcactaagcgccctcgtagggttctggtcgcttcctctgcctcaagtctggcacacgcctccngacatctctcggctcgagtctgacgacgagctgattatactgcagtctcatatgctagttcgttcctnttacaagtntaagttcggggcggacgggaccgtagggccttacggacccgttcgttggacgtcgacggcccgaacgggtccgttcccggtccccccgg

SEQ ID NO: 317018 - DNA, 527 bp, Homo sapiens
  misc_feature: GZ8MTXP01AMRNW.9.21.B10.1.454.CMB.2.raw
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagcccccacactcttaatttatgaggtcactaagcggccctcgaggggtttctggtcgcttcctctgcctcaagtctggcaacacggcctccctgacaatctctggctcagtctgacgngagctgattatactgcagctcatangctagtttcgttcctntttacaagtntaattcgggcgggagggacccgagggtcttggacccttctgaggtccacggccccaagggtccttccggtcccccg

SEQ ID NO: 317019 - DNA, 520 bp, Homo sapiens
  misc_feature: GZ8MTXP01BYWF5.9.21.B10.1.454.CMB.2.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (440)..(440): a, c, t, g, unknown or other
  misc_feature (440)..(440): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggatcaacaacgcccagacaaacgccccacactcttaatttatgagtacactaagcggccctgagggtttctggtcncttccnctgcctcagtctggcaacacggcctcctgacatctntggctcagtctgacgacgaggctgacttatactgcagtctcatatgctagtttcggtcctntttcaagtcttaagttcgggacgggaggacccgaggcttgcccgttctgacgtcacgccccaagggtccttcggtccccc

SEQ ID NO: 317020 - DNA, 737 bp, Homo sapiens
  misc_feature: GZ8MTXP01CTVEE.9.21.B10.1.454.CMB.2.raw
  modified_base (321)..(321): a, c, t, g, unknown or other
  misc_feature (321)..(321): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatccactatctctgcacgtcgacccacactgatagtggactattactaaccttgtctctagactacaaacaaccgaccaagaaaccaaacccgccccaactaccttactttaaatttanaggtacgtacaacgtacgccgtccctaggttagggtttctcggtcgtcttccctcgtcgtccctaccaacgttcgacggaacctaaacccgccggtcccttacccgtagaacctaacgtcctcgttcgggccctacgtacgtcgtacggaaccgtacggtacggtcttagtaactttaactaaccgttcggacgtacgtcccttaacacttaagtcgtaaccgtttacggttttaccggtttccccttacgttttaaacgaaaggttaaacgtttccggttaaccgggggacgggggttaaacgggaaccccggtaaggggtcccttaccgggttaccccgttcccgttaagggacccgttaaccgaacccgggtaccccggaaacggggtccccttaacccccggtccccccggg

SEQ ID NO: 317021 - DNA, 520 bp, Homo sapiens
  misc_feature: GZ8MTXP01CMUMJ.9.21.B10.1.454.CMB.2.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgatattgggctattataaccttgtctcctggatcaacacgcccagacaaacgccccacactcttaattangagtcactaagcgtcctgagggtttcngtcgcttcctctgcctcaagtctggcaacacggcctcctgacaatctctggctccagtcagacgacgaggctgattaatcngcgactctanatntgtctgttcgtcttatacaagtntaacggtcggacgggtaggaccgtagtccgttcgccgttcgtgacgtccgacgccgacgtcccgttccgtccccg

SEQ ID NO: 317022 - DNA, 554 bp, Homo sapiens
  misc_feature: GZ8MTXP01ED97R.9.21.B10.1.454.CMB.2.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (431)..(431): a, c, t, g, unknown or other
  misc_feature (431)..(431): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacatgatattggctattataaccttgtctcctggtancaacaacgccaagacaaacgcccccaanactacttaattatgagtcactaacgcgtccctcgaggggtttctggtcgcttcgtcctcgcctcaagtctagggacaacacggccctccctgacatctctggctccagtctgacgacgaggtctagattatactgccaggcctnattagtgtccgtaggtttcggttccttcttactaaagtattagttcgggacgggagggacccgttagggcctggacccgttcagtaacgtacgaacgcccgtaaggccctccgccccgttcgg

SEQ ID NO: 317023 - DNA, 504 bp, Homo sapiens
  misc_feature: GZ8MTXP01ES2MP.9.21.B10.1.454.CMB.2.raw
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataacctgtctcctggatcaacacgccagacaaagccccanactcttaattatgagtcactaagcgcctnagggttctgtcgcttcctctgcctcaagtctgcaacacgcctcctgacatctctggctcagtctgacgacgagctgacttattactgcagtctcatatgctagtttgtcctntttcaagtntaattcgggcggagggttaccagggcttcgaccgttcctggatcacgcccgaagtccgttcgtcccccg

SEQ ID NO: 317024 - DNA, 631 bp, Homo sapiens
  misc_feature: GZ8MTXP01ALE6W.9.21.B10.1.454.CMB.2.raw
  modified_base (287)..(287): a, c, t, g, unknown or other
  misc_feature (287)..(287): n is a, c, g, or t
  modified_base (498)..(498): a, c, t, g, unknown or other
  misc_feature (498)..(498): n is a, c, g, or t
  modified_base (547)..(547): a, c, t, g, unknown or other
  misc_feature (547)..(547): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgccctcgtgtcgtggtctcgtgacagtcgatccacatcctccgtgacctacgtccgaaccccaccactgtattagtggactattaactaccttgtctcgtagactacaacaccnccaagaaccaacccgcccccaactaccttactttaaatttagacgtacggtaccaacgtaacggcccgtccctacgggttacgggtttcgtggtcctcttccctcgtcgtccctaccgtacgttcgcggaaccaaacgcccggtccctccgtacgaacacttcctcgtcggcctcgactcgagaccgacgtaggtctagtatttacttacngaccgatcctatattagtcgacgtttaggtttccgttccttccgttaanaagtaagttcggtcgggacgggacggacgaggtccttcgttcccgttcgtgtacgcaccgcccgttaggccttcccggtccccg

SEQ ID NO: 317025 - DNA, 586 bp, Homo sapiens
  misc_feature: GZ8MTXP01BK4BG.9.21.B10.1.454.CMB.2.raw
  modified_base (289)..(289): a, c, t, g, unknown or other
  misc_feature (289)..(289): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataacctttgtctcctggtatcaacaacgcccagacaaagcccccanactcttaatttatgaggtcaactaagcggccctgtagggtttctggtcgcttctctgctcaagtctaggcaacacggccctcctgacaatctctggctccagtctgacgacgaggctgattatacngcaggctcatangtctagtttcggttacccttntttcgaaagtacgttaagttcggggcgggttaaacggggacccgttagggtaccgtacggttaccccggttcgttcggaacggttccgaaccggtaccccgaaacgggttcccttcccggttccccccgtttcccggg

SEQ ID NO: 317026 - DNA, 534 bp, Homo sapiens
  misc_feature: GZ8MTXP01CZN6N.9.21.B10.1.454.CMB.2.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (452)..(452): a, c, t, g, unknown or other
  misc_feature (452)..(452): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctctgtancaacaacgccaagacaaacgcccccanactacttaattangagtcaactaagccggccctcgaggggtttctggtctcttctcctgctcaagtctaggacaacgacggcctccctgaacatctctggctcagtcngacgacggngtctagtattactacgtgcagtctatatagtgtcgttgttcgttccttnttacgaagtcgtagtcgggacggaggacacggtctcgaccgttcgttgtaagtccgaacgccgacggttcctccgccccgtg

SEQ ID NO: 317027 - DNA, 567 bp, Homo sapiens
  misc_feature: GZ8MTXP01DGSEI.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactgacccaccactgatatgggctattataaccttgtctcctgatcaacaacgccagacaaacgccccacactcttaattatgagtcactaagcgccctcgtagggtttctggtcgtcttcctctgcctccaagtctggcaaacaccggccctccctgacaatctcgtggctcagtctagacgacgaggtctgaattactactgctagtctcaatagtgccgtaggtttcggttccttctttacaaagtattaacggtttcgggacgggtaggacccgaaggccttacggacccgttcccgtggaaacgtccgacggtaccccgaagggtcccttcccggtcccccccg

SEQ ID NO: 317028 - DNA, 522 bp, Homo sapiens
  misc_feature: GZ8MTXP01B0WZH.9.21.B10.1.454.CMB.2.raw
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatatgggcattataaccttgtctcctgtatcaacaacgccagacaaacgcccccacactcttaatttatgagtcactaagcgccctcgtagggtttctggtcgcttcctctgcctcaagtctgcacacgcctccctgacatctctggctcagtctgacgacgaggctgattatacngcagctcatangctagtttcggttccttnttacaagtntaagttcgggacgggtacggaccgaggtcgttcgaccgttcctgacgtcacgtcccgaggtccttcgtcccccg

SEQ ID NO: 317029 - DNA, 532 bp, Homo sapiens
  misc_feature: GZ8MTXP01AQTNY.9.21.B10.1.454.CMB.2.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (421)..(421): a, c, t, g, unknown or other
  misc_feature (421)..(421): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcccgcctccgtgtctgggtctcctggacagtcgatcaccatctcctgcactggacccacactgatattgggctattataaccttgtctctgtancaacacgcccagacaaacgcccccanactcttaattatgagtcactaagcgccctcaggggtttctggtcncttctcctcgctcagtctgcaacncgccctcctgacatctcgtcggctccagtctgacgtacgaggctagattatactgcaggctanattagtgctagtttcgttcctctttacgaagtattacgttcgggacggagggacccaggtcgtcgacccgttcttaggaacgtcaacgcccgaggcctccgcccccgttcg

SEQ ID NO: 317030 - DNA, 589 bp, Homo sapiens
  misc_feature: GZ8MTXP01EIFLG.9.21.B10.1.454.CMB.2.raw
  modified_base (286)..(286): a, c, t, g, unknown or other
  misc_feature (286)..(286): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcggacccacactgatagttgggctattataaccttgtctcctggatcaacaacgccagacaaacnccccacactacttaattatgagtcactaagccgcctcgtagggtttctggtcgcttcctctcgcctcaagtctgcaacacgccctcctgacatctcgtaggctccgagtctgacgacgaggctagtattaattactgactagtctacataactgtcgtagtttcggttccttcgtttacaaagtcgttaagtttaccggggcgggaaacgggttacccgaagggtccgttacggttacccgttccgttaacgggacgtaaccgacggaccccgttaaacggtcccgttcccgttccccccggg

SEQ ID NO: 317031 - DNA, 526 bp, Homo sapiens
  misc_feature: GZ8MTXP01B152Y.9.21.B10.1.454.CMB.2.raw
  modified_base (287)..(287): a, c, t, g, unknown or other
  misc_feature (287)..(287): n is a, c, g, or t
  modified_base (327)..(327): a, c, t, g, unknown or other
  misc_feature (327)..(327): n is a, c, g, or t
  modified_base (359)..(359): a, c, t, g, unknown or other
  misc_feature (359)..(359): n is a, c, g, or t
  modified_base (438)..(438): a, c, t, g, unknown or other
  misc_feature (438)..(438): n is a, c, g, or t
tcagtgatacgtctcacgaccggtgctcgatttagtgtcgtcgcaagagaggaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgatcaacacgcccagacaaagcccccanactcttaattatgagtcactaagcgccctcgagggtttcnggtcgcttcctctgcctccaagtctggcaacncggcctccctgacatctctggctccagtctgacgacgagctgattatactgcagctcatatgctagtttcggttccctntttacaagtataacgtttcgggcggaaggggttcccagggcttcggcccgttccgtgacgtcacgggcccaaggtccttcgggccccc

SEQ ID NO: 317032 - DNA, 519 bp, Homo sapiens
  misc_feature: GZ8MTXP01DXGCU.9.21.B10.1.454.CMB.2.raw
  modified_base (255)..(255): a, c, t, g, unknown or other
  misc_feature (255)..(255): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactgacccacactgatattggctattataacttgtctctgtancaacaacgccagacaaacgccccacactacttaattatgagtacaactaacgccggccctcgtagggtttctggtcgcttctcctgctcaagtctagacaacgacgcctcctgacatctctggctcagtctagacgacgaggtctagattatactgcaggtctacatatgctagtttcgttccttcttacaagtnttgtcgggnggacgggacaggctgaccgttcttagaactcgaacgcccgagttcctccgccccgttcgg

SEQ ID NO: 317033 - DNA, 518 bp, Homo sapiens
  misc_feature: GZ8MTXP01CMJIY.9.21.B10.1.454.CMB.2.raw
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtancaacaacgcccagacaaacgcccccanactcttaatttatgaggtcactaagcggccctcgaggggtttctggtcgcttctcctgcctcaagtctggcaacacggccctcctgacatctctgggctccagtctgacgacgagctgattatactgcaggctcatatgctagttcgttcctntttcaagtatagttcggcggagggtaccaggtctgcccgttcttcgaagtcaacggcccagggcctcgccccgtcgg

SEQ ID NO: 317034 - DNA, 602 bp, Homo sapiens
  misc_feature: GZ8MTXP01CM34G.9.21.B10.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatagttggntattactacttgtctctganacaacacgaccagaccaacnccccacactacttaattangagtacactacgccgtccgtcgtagggttctcggtcgtcttccctctcgtccctacaacgtctacggccaaaccgaccggtccctcccctagaacctacttcctcgtcggccttaccgagtcctaggacggacgtaggtctagtacttaacttactgcggtactctntaactntcgtaccttaggtttccgttccttacttacgtaaagtaggttaacgttcggggacggtacggggaccctagggtccgttacgttcccgttctaaggacttcgacgtcgacggtccttcccgtccccg

SEQ ID NO: 317035 - DNA, 602 bp, Homo sapiens
  misc_feature: GZ8MTXP01EWD75.9.21.B10.1.454.CMB.2.raw
  modified_base (268)..(268): a, c, t, g, unknown or other
  misc_feature (268)..(268): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggatacagggtcctgggccctgtctgccctgactcagcctgcctccgtgtctgggtctcctggacagtcgatcaccatctcctgcactcgacccacactgatattggctattataactgtctctgatcaacacnccagacaaacgccccacactacttaatttatgacgtacactaagccgccctcgtagggtttctggtcgtctttcctctcgccctaccaagtcctggccaaaccgaccgggtccctccctgaacaactcctcgtcgggctaccgagtctggaacgacggtagtcgtagtatttaacttaactcggacagtctacaatagtcgcgttacgtttcggttccttctttacgaaagtattaacggttcgggcgggtaacggaccgtaagggtccttcggacccgttccgttaacggagttccgaacgtcccgaaaggtcccgttaacccggtccccccg

SEQ ID NO: 317036 - DNA, 608 bp, Homo sapiens
  misc_feature: GZ8MTXP01DMOIN.9.21.B10.1.454.CMB.2.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactggacccacactgatatgggcattataacttgtctctgtatcaacaacacccagaacaaacgccccacactcttaatttangagtcactagcgcctgtagggtttctggtcgcttcctctgcctcaagtctgcaacncgcctcccngacaatctcgnggctcagtctgacgacgngctagattagtactgacagctactagtatcgcgtagtttcggttcccttctttacaaagttacttaacggtttccggggacggggtaacgggaaccccgtaaggggtcccgttacgggttaccccgtttcccggtaacgggaaaccggttccccgaaccgggacccccggttaaaacggggtcccccgtttaaccccggttcccccccccgggg

SEQ ID NO: 317037 - DNA, 565 bp, Homo sapiens
  misc_feature: GZ8MTXP01BUNP0.9.21.B10.1.454.CMB.2.raw
  modified_base (408)..(408): a, c, t, g, unknown or other
  misc_feature (408)..(408): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatatggctattatacctgtctctgatcaacaacgccagacaaacgcccccacactacttaatttatgagtacactaacgccgccctgtagggtttctggtcgtcttcctctcgcctccaacgtctcggcaacaccggccctcctgacatctcgtcggctcagtctgacgacgngctgtattatactgcagtctacatatcgtctaggtttcgttccttcgtttacaaagtgttaacgttcgggacgggtacggaccgtaggtccttaccggttaccgttcccttgggactaaccgacggacccgttaacgggtcccttcccggtcccccg

SEQ ID NO: 317038 - DNA, 534 bp, Homo sapiens
  misc_feature: GZ8MTXP01CWEEY.9.21.B10.1.454.CMB.2.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccacactgatattgggcattataaccttgtctctgatcaacaacgcccaagacaaaacgccccaacactacttaatttatgaggtacactaagcggccctgagggggtttcnggtcncttcctctnactccaatacncgcacacgcctcctacacactctctcgtctcncgtctacgacgacgagngtatatatatagcgatctactatatgtcgtagttcgttcttcttactaagtataagtcggacgggacggacggacggtcgttcgccgttcgtcgtacgtcgacgaccgacgtccgttccgtcccg

SEQ ID NO: 317039 - DNA, 544 bp, Homo sapiens
  misc_feature: GZ8MTXP01A98QS.9.21.B10.1.454.CMB.2.raw
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgccagacaaacgccccacactcttaatttangagtcactaagcggccctcgagggtttctggtcgcttcctctgcctccaagtctggcaacacggcctcctgacatctctcgggctccagtctggacgacgaggctgattatactgcacgntcatatgtctagtttcggttccttctttacaagtntaagttcgggcgggacgggacccgagggccttcggacccgttccgtggaacgtcgacgacccgaacggccgttccgtcccccccgg

SEQ ID NO: 317040 - DNA, 565 bp, Homo sapiens
  misc_feature: GZ8MTXP01B8X31.9.21.B10.1.454.CMB.2.raw
  modified_base (291)..(291): a, c, t, g, unknown or other
  misc_feature (291)..(291): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggctattataaccttgtctcctggtatcaacaacgcccagacaaagcccccanacctcttaatttatgaggtcactaagccggccctcgaggggtttctggtcgtcttcctctgcctccaagtctggcacacggcctccctgacaatctctggctccagtctgacgacgaggctgattatactgcagctcatatgctagtttcggttccttctttacaaagtattaacgttcggggttcgggaagggttccccgtaagggccttcggttaccccggttcctggacgttccgacgtaccccgaagggtccccgttccgtcccccccgg

SEQ ID NO: 317041 - DNA, 601 bp, Homo sapiens
  misc_feature: GZ8MTXP01B336K.9.21.B10.1.454.CMB.2.raw
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacaggtcctgggccctgtctgccctgactcagcctgcctccgtgtctggtctccgtggacagtcgatcacatctctgcactcggacccacactgatagtggactattataaccttgtctctgtatacacacgccagacaacgccccacactctaattatgagtacactacgccgccctcgtagggtttctggtcgtcttcctctcgcctaccgtaagtcgtcgcaaccgaccggccctcctagacaactctcgtcggcctcagtcgtgaacgacgngctagattatactgcngctacagtntacgtcgttaggtttcggttccttactttacgaaagttagttaacggtttacggggccgggtaacgggacccgtaaacgggtccgttacggttacccgttccggttaaggacggttaacccgacgggaccccgaacgggtccccgttcccgggttcccccccg

SEQ ID NO: 317042 - DNA, 660 bp, Homo sapiens
  misc_feature: GZ8MTXP01CPRBT.9.21.B10.1.454.CMB.2.raw
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcacatctctgcactcgacccacactgatatggctattatacttgtctctgatcaacacnccagacaacnccccacactacttaattangagtacactagccgtcctcgtagggttctggtcgtcttccctctcgcctacctaacgtccgtacgccaaccgtacccggtccctccccgtagaacctaactctccgtgggccttaccgagtcctacggaaccgtacggaaggtctagtaacttacttactgactaacgtctaacctattacgtcgtaccgttaagttttccggtttcccttacgtttaaccgtaaaggttacgtttaacgggttccggggacggggttacggggacccgtaacgggtccttacccggttacccggttacccgttaagggaacccggttccgaaccggaccccggttaacgggtcccccgttaacccgttccccccgg

SEQ ID NO: 317043 - DNA, 509 bp, Homo sapiens
  misc_feature: GZ8MTXP01B12T5.9.21.B10.1.454.CMB.2.raw
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (419)..(420): a, c, t, g, unknown or other
  misc_feature (419)..(420): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacacgcccagacaaagcccccacactcttaatttatgagtcactaagcgccctcgagggtttctggtcgcttcctctgcctccaagtctggcaaacacggccctccctgacaatctctggctccagtcctgacgngagctgattattcngcnnctnatntgctgttcgtctnttanagtntaagtcggaggacgacgtgtcttcgttccttcgtgacgtcacgccgacgtccttccgtcccg

SEQ ID NO: 317044 - DNA, 563 bp, Homo sapiens
  misc_feature: GZ8MTXP01DLZB5.9.21.B10.1.454.CMB.2.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactggacccacactgatattgggctattataaccttgtctcctggtatcaacaacgccaagacaaacgccccanactcttaattangagtcactaagcggcctgagggtttctcggtcgcttcnctcgcctcaagtctgcaacaccggcctccagacaatctctgggctcgagtctagacgacgaggctagtattaacttactgacgactctcaaatntcgtctaaggtttcggttccttactttacgaaagtattaaggttacgggcggggaacggaccgaaggtccgttacgttacccgttccgtgacgttcgacgcccgaaagtcccgttcccgtccccccgg

SEQ ID NO: 317045 - DNA, 558 bp, Homo sapiens
  misc_feature: GZ8MTXP01DWXPG.9.21.B10.1.454.CMB.2.raw
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatattggctattataaccttgtctcctggtatacaacaacgcccagacaaacgcccccacactacttaatttatgagtcactaagcggccctcgaggggtttctggtcgctttccnctgcctcagtctgcaacncgcctccngacatctntggctcagtctgacgacgagctgattattactgcagctacagtatcgtacgtaggtttcgttccttcgtttacaaagtcttaagtttcggggacgggtacgggaccgagggtccttacgggcccgttcccgtgacgtccgacggaccccgaaggtcccgttccggttccccccg

SEQ ID NO: 317046 - DNA, 661 bp, Homo sapiens
  misc_feature: GZ8MTXP01D9OWR.9.21.B10.1.454.CMB.2.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (304)..(304): a, c, t, g, unknown or other
  misc_feature (304)..(304): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatcctcctgcactggaaccngcagtgatggtggattatgaccttgtctctggtaccaacngacaccaggacaaacgcccccaaatcatctatttangagtacacgtaagcgcctacgtaggtttctattccgcttctcgtgcctaaccaagttcagaaccaaacgaccgccctaccctgaactaacttctcgttcgggcttacccgaggtacctagggacggaaccgagggcctaagggttaatttacgtttaacctggtcgtcgtaccttctaaagttagtacgtacgtagtacggttacgggtaccgtaacccgttaaccggttccgggttagggttaacggttaccggggtaacggggaaccgggttaaccggttacgggttacccggtaacccggttacggtaacggtaccggaccggttacccggtaacggttcccgttaaccccggg

SEQ ID NO: 317047 - DNA, 552 bp, Homo sapiens
  misc_feature: GZ8MTXP01DN1EB.9.21.B10.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactgacccaccactgatattgggctattataaccttgtctcctgatcaacaacgccagacaaacgccccanactcttaatttangagtcactaagccgcctcgagggtttctggtcgtcttcctctgcctccaagtctggcacaccggccctccngacatctctggctcagtctgacgacgaggtctgattattactgcgagtctactatatgccttagttcggttccttntttacaagtataacgttcgggcggtacgggaccgtaagggtcttacggttcccggttacctggaacgtcgaccggacccgaacggtccgttcccggtccccccg

SEQ ID NO: 317048 - DNA, 733 bp, Homo sapiens
  misc_feature: GZ8MTXP01DRC8C.9.21.B10.1.454.CMB.2.raw
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccaccactgatatgggctattataaccttgtctctgtatcaacacgccaagacaaacgccccacactacttaaatttatagacggtacactaacgcggtcccgtcgtagggggtttcttggttccgtcttcctcctcggtccttaccgtaacgtccgttacgggacctaaccgaccgggtccccttaccccgtacggtaacctaacttcctccgggtcgggcccttaccctagtccgtacgaccggaacggtaacggtcctaggttaacttaaacttcctaggtaccacggggtaccttacgtaattaaccgtggttaccgttaacggttttcggtttacccttttcgttttaaccgaaaggttaaacgtttcggtttaacccgggggacgggggttaaacggggaaacccttcggggttacgtaccggttaaccccgggttctttaaacgggccgttacccgtaaccggaccccgttaacgggcccgttccccggttcccccgtttcccggg

SEQ ID NO: 317049 - DNA, 612 bp, Homo sapiens
  misc_feature: GZ8MTXP01CJ664.9.21.B10.1.454.CMB.2.raw
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggcattactaaccttgtctcctggatcaaacaacgccaagacaaacgccccanactcttaattangagtcactaacgcgcctgtagggtttcncggtcgcttcctctcgcctcaaagtctaggccaaacacggccctcccctanaactactctcgtcgcctcgacgtcgtacggaaccgacggacgtacgttagttaacttaacgttacgtacgtacgtacgtactactacgtatcgtacgttacgtttacgtttccgttaccttacgttaacgtaagttaacggttacgggttacgggtacgggaccgtacggtacgttcgttccgttaccgtaacgtacgtaaccgacgaccgacgtccgttcccgtcccg

SEQ ID NO: 317050 - DNA, 689 bp, Homo sapiens
  misc_feature: GZ8MTXP01CBNO4.9.21.B10.1.454.CMB.2.raw
  modified_base (283)..(283): a, c, t, g, unknown or other
  misc_feature (283)..(283): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtatctgggtctcctggacagtcgatcaccatctcctgcactcggacccacactgatagttgggactattataaccttgtctcctgatcaacacgccagaaacnccccacactcttattatgagtcactaagcggccctctagggttcgttgtcgtcgttctcctcgcctcctaagtcgtgacaaccgacgcccgtccctacgactaactctcgtcggtacgtcctaacgtccgttcgaacggtaaccggagggtacccttggtactttaaacttaaccgttcgtaccgaacgggtcttacgtaacttaagttcgtacgtaccggttttagggttttccctttacctttacgttaaaccgtaagtttaggttccgggggtaacgggttcgggggtaaaacccttcggggaaccgtttccgttaaccccggttccggttacggtaaccggttacgaaccccgggtacccgtaaacggggccctttcccccggttcccccggtttccccggg

SEQ ID NO: 317051 - DNA, 576 bp, Homo sapiens
  misc_feature: GZ8MTXP01BHGSL.9.21.B10.1.454.CMB.2.raw
  modified_base (305)..(305): a, c, t, g, unknown or other
  misc_feature (305)..(305): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaacgccccacactacttaatttangagtcactaagcgccctcgagggtttctggtcgcttcctctgcctcagtctggcacacgccctcctgacatctcgtggctccagtcctgacgacgaggctgtattatactgcaagtctcatttagcgtactaggtttcgggttcccttcgtttactaacgtattaacggtttcggggacgggtacggggacccgaagggtcgttaccgggttacccggttcctggtacgttcgacccggcccgaacggggtcccttccccgggtcccccgg

SEQ ID NO: 317052 - DNA, 543 bp, Homo sapiens
  misc_feature: GZ8MTXP01EPH7N.9.21.B10.1.454.CMB.2.raw
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactgacccacactgatattgggcattataaccttgtctcctggtatcaacaacgcccagacaaagcccccanactcttaatttatgagtcactaagccggtccctcagggggtttcnggtcgcttcctctgcctcagtctgcacacgcctcctgacatctctggctcagtcctagacgacggngctagtattatatgcgatctcatatgtcgtagttcgttcttcttacgaacgtagtaacggttcgggacgggacgggaccgtacggtcgttacggccgttccgtgacgtccgaccgacccgacggtcccgttcccgtcccccg

SEQ ID NO: 317053 - DNA, 582 bp, Homo sapiens
  misc_feature: GZ8MTXP01CFCQB.9.21.B10.1.454.CMB.2.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcggacccacactgatattgggacattataaccttgtctcctgactcaacaacgccagacaaacgccccacactacttaatttatgagtcactaacgcggcctcgtagggtttctggtcgtcttcctctgcctccaagtctgcaacaccggccctcctagactaatcctcgtggctccagtctgacgacgaggtctgtattatactgacagtctacgatatgactagtttcggttcccttctttacaaagtacttaacggttcggggacgggtaacgggaccgtaacggtccgttaccggacccgttcccgtggtacgtccgaacggtaccccgaaacgggtccccttccgggttcccccccg

SEQ ID NO: 317054 - DNA, 564 bp, Homo sapiens
  misc_feature: GZ8MTXP01B6GFQ.9.21.B10.1.454.CMB.2.raw
  modified_base (458)..(458): a, c, t, g, unknown or other
  misc_feature (458)..(458): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggatcaacaacgccagacaaacgccccacactcttaatttatgaggtcactaagccggccctcgtagggtttctggtcgcttcctctgcctcaagtctggcaacacggccctccctgacaatctctggctcagtctgacgacgagctgattatactgcagtctcatatgctagtttcggttccttcttactaaaggtnttaacgtttcgggcgggtaacgggaccgaaggggtccttacggacccgttcccgttaaggacgttaaccgaacgtccccgaaagggtcccttccggtccccccccg

SEQ ID NO: 317055 - DNA, 569 bp, Homo sapiens
  misc_feature: GZ8MTXP01A1LCR.9.21.B10.1.454.CMB.2.raw
  modified_base (336)..(336): a, c, t, g, unknown or other
  misc_feature (336)..(336): n is a, c, g, or t
  modified_base (471)..(471): a, c, t, g, unknown or other
  misc_feature (471)..(471): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatattgggctattataaccttgtctcctggtatcaacaacgcccagacaaacgccccacactacttaactttatgaggtcactaagcggccctgtagggtttcnggtcgcttcctctcgcctcaagtctcggcaacaccggccctccctgactaactctctggcctccgagtctgacgacgagctagattattactgcagctcatatcgctagtttcgttcccttcgtttacaaacgtntaacgttcgggcggtaacgggccgaaggtcgttcggttaccgttcccgtaaggacgttccgaacggccccgaaggggtcccttccggttcccccccgg

SEQ ID NO: 317056 - DNA, 552 bp, Homo sapiens
  misc_feature: GZ8MTXP01AX6HQ.9.21.B10.1.454.CMB.2.raw
  modified_base (372)..(372): a, c, t, g, unknown or other
  misc_feature (372)..(372): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatatgggctattataaccttgtctcctgtatcaacaacgccagacaacgccccacactcttaattatgagtcactaagccggccctcgaggggtttctggtcgtcttcctctgccctcaagtctgcacacggcctccngacatctctcggctcagtctgacgacgagtctgtattactacgtcgcagctacattatgctagtttcggttcctctttacgaagtattaacgttcgggcgggtacgggaccgtagggtcttacggttccgttccgtaaggtcgtaacaccgcccgaacggtcccgttcccgtccccccgg

SEQ ID NO: 317057 - DNA, 539 bp, Homo sapiens
  misc_feature: GZ8MTXP01AYZ8M.9.21.B10.1.454.CMB.2.raw
  modified_base (301)..(301): a, c, t, g, unknown or other
  misc_feature (301)..(301): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccccacactgatagtggctattataacttgtctctgatacaacacgccagacaacgccccatactcttaatttangagtcactaacgccgcctcgtagggtttctggtctcgttcctctcgcctacagtctggcaccgacggtccctcctgactactctcgnggcctcgngtctgacgacgaggctgtattatactgacagctanctagtcgacgtgtttcgtttccttctttaanaagtcgtaagttccgggaggacggacgtaggcttcgaccgttccgtaagcgtcacgcccgagtcccttcggtccccg

SEQ ID NO: 317058 - DNA, 535 bp, Homo sapiens
  misc_feature: GZ8MTXP01BFRWL.9.21.B10.1.454.CMB.2.raw
  modified_base (291)..(291): a, c, t, g, unknown or other
  misc_feature (291)..(291): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctcctggtatcaacacgccagacaaacgcccccanactcttaatttatgagtcactaagccgccctcgagggtttctggtcgcttcctctgcctcaagtctggcaacacggcctcctgacaatctctggtctcagtctgacgacgagctagattatatgcagtctcatatcgctagtttcggttcctgtttaccagtataagttcggcgggtaacggccgtaggcttcggaccgttccgtgtacgtcacggccccgaaagggtcccttcgtccccccgg

SEQ ID NO: 317059 - DNA, 602 bp, Homo sapiens
  misc_feature: GZ8MTXP01DSW4Q.9.21.B10.1.454.CMB.2.raw
  modified_base (364)..(364): a, c, t, g, unknown or other
  misc_feature (364)..(364): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatgggctattataccttgtctctgatcaacaacgccagacaaacgccccacactacttaatttatgagtcactaagcggtccctcgtagggtttctggtcgtcttcctctgcctccaagtctgcaacnccggcctccctgacatctcgtggcctcgagtctgacgacgaggctagattatactgactacgtctcaattagtgcgttaggtttcgttcccttacttttaccgaaagttcgttaacggtttccggggacgggtaacgggaccgtacgggtccgttaccggttacccggttcccgtaagggaaccgttcccgaaccgggccccgttaaagggtccccgttaacccgggtccccccccgg

SEQ ID NO: 317060 - DNA, 559 bp, Homo sapiens
  misc_feature: GZ8MTXP01DUSKW.9.21.B10.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggctattatactgtctctgtatcaacacgccagacaaacgccccacactcttaatttangagtcactaagcgccctgagggtttctggtcncttcctctgcctcaagtctgcacaccgcctcctgacatctcgtggctccagtctgaacgacgaggtctagattattactgcacgtctactatatcgtctacgtttcgttccttctttacaaacgttntaacggtttcgggaccgggtaacgggacccgtagggtcttcggacccgttacccgtggtaacgttccgaccggacccggaacgggtcccttccggtcccccccg

SEQ ID NO: 317061 - DNA, 583 bp, Homo sapiens
  misc_feature: GZ8MTXP01CUYJY.9.21.B10.1.454.CMB.2.raw
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctctgcactcgacccaccactgatattggctattataaccttgtctctgtatcaacacgccagacaacnccccanactctaattangagtcactagcgcctgtagggttctggtctcttcctctcncctcaagtctgcacaccgtcctccagactatctcgtcgctcagttcacgacgacgagtctgtattatactcgacagtcttacattaactgaccgttacgtttcggtttcccttacgttttaacaagtaagtttcgggttaacggggcggggttaaacgggccgtaaacggggtcttaacccgggttccggtttcccaaggtaacgttccgaacgaccccgttaacggtcccgttcccgggtccccccg

SEQ ID NO: 317062 - DNA, 557 bp, Homo sapiens
  misc_feature: GZ8MTXP01A9ZR4.9.21.B10.1.454.CMB.2.raw
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactggacccaccactgatattgggctattataaccttgtctctgatacaacacgccagacaacgccccacactacttaattangagtcactaacgcgccctcgtagggttctggtcgcttcctcgtgctcaagtctacgcaacncggcctccngacatctcgtggctcgagctgacggcgaggctgtatttattactggctcgtctcattacgngcgagtgtggtactaccgtccgtccggttaaggtacggttcgggacgggacggtaaaccgtacggggttaccgttccggttaccgtaaggtccgaacgacccgtacggttcctcccggccccgtg

SEQ ID NO: 317063 - DNA, 665 bp, Homo sapiens
  misc_feature: GZ8MTXP01DGIR3.9.21.B10.1.454.CMB.2.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcacatctctgcactcgacccacactgatagttggctaattactaaccttgtctcctgtactacaacaaccgccaagaccaaacgccccacactacttaattangagtacactaacgccgcctcgtagggtttctggtcgtcttccctctcgtcctcaagtctaggccaacnccggccctcccagacaatctcgtcggctccgagtctacgaacgacgtacggtctagtactttaactacgtcgactacgtcctaactaattagtacgtacgttaaggtttcccggtttacgttttaccctttaccgtttaaacgaaaggtttaacgtttaccgggttaccgggggtaaccgggttaaaccgggacgtaaccggttcggttaaacccggttcccgtcgttaacggtaacccgtaacccgtacccgggaaacccgttcccgggttccccgttcccccccggg

SEQ ID NO: 317064 - DNA, 555 bp, Homo sapiens
  misc_feature: GZ8MTXP01APCQI.9.21.B10.1.454.CMB.2.raw
  modified_base (261)..(261): a, c, t, g, unknown or other
  misc_feature (261)..(261): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcgacccacactgatagttggctattactaaccttgtctcctggtancaacacgccagaacaaacgacccccacactacttaatttatgagtcaactaacgcggtccctcgtaggggtttctggtcgcttctcctcgcctacagtctaggacaaccgacgcctcccngacatctcgtggctcagtcngagacgagctgtattattacngacngctntatatgtcgttcgttcgttacttacgttacaagttcgtgggtcgggcgggacggaccgttaggtccgtaccggttccgttcgacgtaacgtcgaaccgccggtacgcccgtcccgttccccgtcg

SEQ ID NO: 317065 - DNA, 659 bp, Homo sapiens
  misc_feature: GZ8MTXP01DRU43.9.21.B10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcatcacatctcctgcactcgacccacactgatagtggactattatactntctctganacaacacnccagacaacgccccanactacttaattangagtacacgtaacgcgtcccgtcgtagggtttctggtcgtcttccctctcgcctacctacgtctcgaaccaaccgacccggtccctccccgtagaacctacgtcctacgttcggcctccgtagtccgtagaaccggacgtaggtctaggtaatttacgttaacgtcgacgtacgtcctataacgttagtcgtaccgtttaaggttttccggtttacccctttagtttaaccgaaagttacgttaacggttccggggaccggggtaaacggaccgtacgggtaccttacccggttccggttacgtaaggtaccggtccgaacccggccccgttaacgggtccccgttaaccccggttccccccgg

SEQ ID NO: 317066 - DNA, 579 bp, Homo sapiens
  misc_feature: GZ8MTXP01BC65G.9.21.B10.1.454.CMB.2.raw
  modified_base (284)..(284): a, c, t, g, unknown or other
  misc_feature (284)..(284): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatattgggctattataccttgtctctgatcaacacgccagacaacgccccanactacttaattatgagtcactaagccgcctcgtaggttctgtcgtcttcctctgcctcaagtctcgcaacaccggtccctccctagactaatcctcgtggcctcgagtctaggacgtacgaggtctagtacttattacgtgacgtactctacagttaatcgtacgttacggtttcggtttacccttcctttacgaaagtacgttaacggttccgggacgggtacgggttaccgaacgggtcttccgttaccgttccgtgaccgtcgacgcccgaagggtccttcccggtcccccg

SEQ ID NO: 317067 - DNA, 561 bp, Homo sapiens
  misc_feature: GZ8MTXP01AQJKC.9.21.B10.1.454.CMB.2.raw
  modified_base (521)..(521): a, c, t, g, unknown or other
  misc_feature (521)..(521): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatatggctattataacttgtctctgatcaacacgccagacaacgccccacactctaattatgagtcactaagcgcctcgtagggtttctgtcgcttcctctgccctcaacgtctcggcaacaccggcctcctacgactaatctctgggcctccgagtcgtagacgtacgagtctagtattagtctcgcagtctcatacgtgtacgtagtttcggtttcccttcgtttaaccgaagtagttaacgttacggggaccggggtacgaccgtagggccgttacgccgttcnggtacgtcgacgtccgacggtccttcccggttaaccccgg

SEQ ID NO: 317068 - DNA, 576 bp, Homo sapiens
  misc_feature: GZ8MTXP01EJ3RS.9.21.B10.1.454.CMB.2.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (472)..(472): a, c, t, g, unknown or other
  misc_feature (472)..(472): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcatcaccatctcctgcactcgacccacactgatagtggactattataacttgtctctgatacaacacgccagaacaacgccccanactacttaattangagtcactaagccgcctgtagggttcnggtcgtcttctctgtccctacaacgtctcggcaaacgccgccctcctagactactctcgtcggcctaccgagtcgtagaaccgtacgacggtctagtaactttagtactgacggatctactatacgtgtactaggtttcgttacctnttaattacgaaagtaagtacgttcgggcgggaaacggtacctaggttccgttcggttacccgtcgtagtaacgtaccacggacccgtaaggttcccgtccccgg

SEQ ID NO: 317069 - DNA, 685 bp, Homo sapiens
  misc_feature: GZ8MTXP01BB4LK.9.21.B10.1.454.CMB.2.raw
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactgacccacactgatattggctattatacttntctctgtatacaacaacgccagacaaacgccccacactacttaattangagtacactaacgcgcccgtcgtacgggtttctggtcgtcttccctctcgtccctaccgtaagtcctacgcaaaccgtacccggtccctaccctacgaactaactcctcgtggacctccgagttccngaacccgaggacgtctagatttacttacgngacgtactccttacaattagtccgtacgttaacggttttccggttaccctttacgttttaacccgaaacggttaggtttaaacccgtttccgggggaccggggaacgggttaccccgaacggggttaccgttacccgggttaccccggttaccccgttaagggaaccggttccccggaaacccgggttaccccgaaaccggggtccccgttaaccccgggtcccccccgg

SEQ ID NO: 317070 - DNA, 551 bp, Homo sapiens
  misc_feature: GZ8MTXP01EXV7K.9.21.B10.1.454.CMB.2.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatattggcattataactgtctctgatcaacacgccagacaaacgccccacactcttaattactgagtcactaagccgcctcgtaggttctggtcgcttcctctgcctcagtctgcacaccgcctcctgacatctcgtggcctcgagtctaggaacgacgaacggtctagtacttattaaccgtgctaacgtcctatatatcggcttaacggtttcggtttcctcgtttaacgaagtgtaacgttcgggacggacggttaccgaagcgttacgcccgttcgtaagcgtaacgacgacccgaggtcccttccgtcccccg

SEQ ID NO: 317071 - DNA, 589 bp, Homo sapiens
  misc_feature: GZ8MTXP01BSKOJ.9.21.B10.1.454.CMB.2.raw
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (425)..(425): a, c, t, g, unknown or other
  misc_feature (425)..(425): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatggctattatacctgtctctgatcaacacgccagacaaacgccccacactacttaattatgagtacactaacgccggtcctcgtagggtttctggtcgtcttcctctgcctcaagtctgcacncgcctccngacatctcgtggctcagtctgacgagagctagattactactgacagtctacagttancgtcttacggtttcggtttccttacgtttacgaaagtacgttcgttacggggcgggtaaacgggaccgtaacggtcgttaccggacccggttcccgtaagggtaccgttaaccggaacccggtaccccggttaacgggtcccgttccccggggttcccccccgg

SEQ ID NO: 317072 - DNA, 602 bp, Homo sapiens
  misc_feature: GZ8MTXP01DV5WR.9.21.B10.1.454.CMB.2.raw
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
tcagtgatacgtctcacgaccggtgctcgatttagtgtcgtcgcaagagaggaggggggggtcacaagaggcagcgctctcgggacgtctccaccatggcctgggttctgctgctcctcaccctcctcactcaggacacagggtcctgggccctgtctgccctgactcagcctgcctccgtgtctgggtctcctggacagtcgatcaccatctcctgcactgacccacactgatattggctatttataaccttgtctctgtancaacacgccagacaaacnccccanactacttaattatgagtcactaacgcggccctcgtagggggtttctcggtcgtcttcctcctcgtcctccaagtctacggactaaccgaccggtccctccccgtacgaccaattctcgtcgggtccttccgaacggtctaggaccggaaccggtagggtacctagtaatttaacttactcgcaacggtcttactatagtgtcctagtttcggtttccttctttacaagtagtacgttcgggcgggacgggtacgcggtacgtcggttaccgttccgttggaacgtcgaacgcccgaacggcgtccgcccccgtcg

SEQ ID NO: 317073 - DNA, 595 bp, Homo sapiens
  misc_feature: GZ8MTXP01BKLLR.9.21.B10.1.454.CMB.2.raw
  modified_base (401)..(401): a, c, t, g, unknown or other
  misc_feature (401)..(401): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcggacccacactgatattgggctattataaccttgtctcctgatcaacacgccagacaaacgccccacactcttaatttatgaggtcactaagccggccctcgtacggggtttctcggtcgtcttcctctcgccctcaacgtctcggcacaccggccctccctgacatctcgtggcctcngtctgaacgcggagtctagtattactacgtcgcgaagtctactatatcgtcgttagtttcgttcccttacgtttacaaagtacgttaacggttccgggacgggtaacgggaccgtagggtccttaccggttaccgttccgtggtaccggtaacgacccgggtacccgaacgggtcccgttcccggtccccccgg

SEQ ID NO: 317074 - DNA, 525 bp, Homo sapiens
  misc_feature: GZ8MTXP01CYHUE.9.21.B10.1.454.CMB.2.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataccttgtctctgatcaacaacgccagacaaacgccccacactcttaatttangagtcactaagccggccctcgagggtttctggtcgcttccgtctgcctcagtctgcacacgcctccnacatctntggctcngtctgacgacgagctgattatactgcagtctcatatcgtctaggtttcggttcccttntttacgaagtcttaacgttcggacgggtagggacctagggcttcgaccgttcctggactccgagtcccgaaggtccttccgtcccccg

SEQ ID NO: 317075 - DNA, 563 bp, Homo sapiens
  misc_feature: GZ8MTXP01DRIKZ.9.21.B10.1.454.CMB.2.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctctgcactcgacccacactgatatggctattataaccttgtctcctgatcaacaacgccagacaaacgccccanactcttaatttatgagtcactaagccgcctcgtagggtttctggtcgcttcctctcgcctcaagtctggcaacncggccctccctagacatctcgtgggctccagtctgaacgtacgaggtcctgtattattacngacgtatcctnaatagtgtacgtaggtttcggttccttagtttaccaaggtnttaacggttcgggcggtacgggaccgaaggtcgttacgaccgttccgtggtacgtcgacggccccgaaggtcccgttcccgtcccccgg

SEQ ID NO: 317076 - DNA, 578 bp, Homo sapiens
  misc_feature: GZ8MTXP01EXHGN.9.21.B10.1.454.CMB.2.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatatggctattatacttgtctctgatcaacacnccagacaacnccccacactacttaattatgagtacactaacgccgcccgtcgtagggtttctggtcgtcttcctctcgcctcaacgtctcgcaacgaccgccctcctagacactctcgtggctcgatctagacgacgaggtctagtatttacgttacncgacagtctactatagtcgcgttaggtttcgttcccttacgtttacgaagtntaaggttccgggacggggaacggttaccgtcggtccttacgggacccttcgtaaggtacgtaacgaccggacccttaaggggtcccttccgggtaacccccg

SEQ ID NO: 317077 - DNA, 694 bp, Homo sapiens
  misc_feature: GZ8MTXP01BG14U.9.21.B10.1.454.CMB.2.raw
  modified_base (284)..(284): a, c, t, g, unknown or other
  misc_feature (284)..(284): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacaggtcctgggccctgtctgccctgactcagcctgcctcgtgtctggtctcctggacagtcgatcaccatctcctgcactcggacccacactgatagtggactattatactgtctctgatacaacacgccagacaaccgccccanactacttaattatgtagtacacgtaacgccgccttcgtacgggtttctggtcgtcctttcctctacgtccctacgtaacgttcgtacggccgaaaccgtacccgggtcccttacccgtacgtaaccctaaacgttcccgttacgtcggggtaccctaccggtaagttccgttacggaaccggtaaacccggtgggtaccttaggttaactttacttaacgttcgacgggtacgttactacctaagttactcggtaccgtttaggtttcccggttactttccgtttaaccaaacgttagttaacggttacggggacggggtaaccgaccgtaacggtcgttaccggttcccgttacgtaacggtacgtaaccaaccggaccccgttaagggtcccctttcccggtcccccg

SEQ ID NO: 317078 - DNA, 581 bp, Homo sapiens
  misc_feature: GZ8MTXP01D583S.9.21.B10.1.454.CMB.2.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (454)..(454): a, c, t, g, unknown or other
  misc_feature (454)..(454): n is a, c, g, or t
  modified_base (546)..(546): a, c, t, g, unknown or other
  misc_feature (546)..(546): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgatcaccatctcctgccactcgacccacactgatntggctattatactntctctgatcaacacgccagacaaacgccccatactacttaattatgagtacatacgcccgcctcgtagggtttctggtcgtcttcctctcgccctacaagtctacgcgaacaccggtccctaccctacgactatcctcgtagggccctcgagttcaggaacgtacgaggtctacgtattatacgtgactagtctactattacgngtacgttgtttcgttcccttagtttacaaagtgtaaggttcggacggggacggaccgtagtccgttcggaccccgttgtaaggacgtaaccnccggacccgaaggtcccgttaacccggtcccccgg

SEQ ID NO: 317079 - DNA, 590 bp, Homo sapiens
  misc_feature: GZ8MTXP01CRMLF.9.21.B10.1.454.CMB.2.raw
  modified_base (394)..(394): a, c, t, g, unknown or other
  misc_feature (394)..(394): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataccttgtctctgatcaacacgccagacaaacgccccacactacttaatttatgagtcactaacgcgccctcgtagggtttctggtcgtcttcctctcgcctccaagtctggcacgccgcctccagacactctcgtcggcctcgngtctacgacgacggtgtctagtactttaatcgtcgactacgtctactaacttgtcgtcgttagtttccggttccttacgttaacgtaagttattaacgggttacgggcgggtaacgggacgtaacgggcgttaccggaccgttcgttaacggacgtccgaccggacccgaacggtcccgttaacccgttcccccgg

SEQ ID NO: 317080 - DNA, 565 bp, Homo sapiens
  misc_feature: GZ8MTXP01C8GZ5.9.21.B10.1.454.CMB.2.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactcggacccacactgatattgggctattataaccttgtctctgtatcaacacgccagacaaacgccccacactcttaatttangagtcactaacgccgcctcgtagggtttctggtcgcttcctctgcctcaagtctgcaacnccggcctccctgacatctctcggctccagtctagacgacgagctagtattattactgctaagctactagtaatgcgttagttcggtttcccttntttacaagtattaacggttcgggcgggtacggaccgagggtcttaccggaccgttcccgtaaggtaccgtccgacggcccgttaaacgggtcccgttcccgtccccccgg

SEQ ID NO: 317081 - DNA, 563 bp, Homo sapiens
  misc_feature: GZ8MTXP01EQL5D.9.21.B10.1.454.CMB.2.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactcggacccacactgatattgggactattataaccttgtctctgatacaacacgccagacaacgccccacactacttaatttatgagtacactaacgccgcctcgtagggtttctggtcgtcttcctctgcctcaagtcncgcaacnccggccctcctagacatcctcgtcggctcgagttccagacgacgaggctagtacttatactgcagtctactaatntgcgttagtttcggttccttcttacaagtagttcgtacgggacgggacggaccgtaggtccttacggttcccgttcgttgacgtcaccggacccgttaacggtcccttcccggttcccccgg

SEQ ID NO: 317082 - DNA, 552 bp, Homo sapiens
  misc_feature: GZ8MTXP01BCAKN.9.21.B10.1.454.CMB.2.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatattgggctattataaccttgtctctgatcaacacgcccagacaacgccccacactacttaatttatgaggtcactaagccgccctcgtagggtttctggtcgtcttcctctcgcctcagtctcggcaaccnccggcctccngacatctctggctcngtctgacgacgagctagtattatactgcacgtctacattatgcttacggtttcgttccttcttacgtaagtcgttaacggtttcgggaccgggacggccgacgggtcttacggcccgttccgtgacgtccacggtcccgaggtcccgttcccgtcccccg

SEQ ID NO: 317083 - DNA, 546 bp, Homo sapiens
  misc_feature: GZ8MTXP01CMVYT.9.21.B10.1.454.CMB.2.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
  modified_base (517)..(517): a, c, t, g, unknown or other
  misc_feature (517)..(517): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactcggacccacactgatagttgggactattataaccttgtctcctgatcaacacgccagacaaacgccccanactctaattangagtcatacgcgccctcgagggtttctggtcgcttcctctgcctcaagtctgcaacacgcctcctgactaatctcgtcggctcagtctgacgacgaggctagtacttatctgacngtctcattatgtctaggtttcgttcccttcgtttacaaagtnttaagttcgggcgggtaaggaccgtagggtcttcggacccgttccgtaagacggtaacncggacccaacgggtccttccgtccccccg

SEQ ID NO: 317084 - DNA, 652 bp, Homo sapiens
  misc_feature: GZ8MTXP01CWMPS.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataaccttgtctctgatcaacaacgccagacaaacgccccacactcttaatttatgaggtacactaacgccggtcctcgtaggggtttctggtcgcttcctctcgccctaccaagtcctggccaaaccgaccgggtccctccctagacctaaacttcctacgtcgggccctaccgtagttcgtacggaaccgtacggacggtacctagtaatttagttaacgtcggactaacggtcttacctagttaagtcggtacctttaggtttccggtttccctttacttttaccgaaagttacgttaagtttccggggcgggtaaacgggaccgtaacgggtcgttaccggttcccggttcccgtaagtacgtccgaacggccccgaaggtcccttccggttccccccgg

SEQ ID NO: 317085 - DNA, 668 bp, Homo sapiens
  misc_feature: GZ8MTXP01ESQTK.9.21.B10.1.454.CMB.2.raw
  modified_base (256)..(256): a, c, t, g, unknown or other
  misc_feature (256)..(256): n is a, c, g, or t
  modified_base (321)..(321): a, c, t, g, unknown or other
  misc_feature (321)..(321): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactcgacccacactgatatggctatatactgtctctgancacacgccagacaacgccccacactacttaattatgagtcactaagccgtcctcgtagggtttcngtctcttcctctcgcctccgtaagtctacggcaacgaccgtccctcctagaacatctcgtggcctaccgagtctaggaaccgacgggacggtacttagtatttaacgtacgtgactaacgtcctaactagttacgtcgtaccgttacggttttcggtttccccttagttttaaaccgaaacggttaagtttaaccgggttacggggacccgggggaaacggggttaacccgtaaacggggttcccgttaccgggttaaccccgttcccggttaagggaacccgttaacccggtaaccggaccccggttaaaccgggtccccgtttaacccccgggttccccccccgg

SEQ ID NO: 317086 - DNA, 550 bp, Homo sapiens
  misc_feature: GZ8MTXP01BLM79.9.21.B10.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactcggacccacactgatatggctattataacttgtctctgtatcaacacnccagacaacgccccanactcttaatttangagtacactaacgccggccctcgtacggggtttctggtcgtctttcctctgccctctaagtctggcaaccnccggccctcctgactaattctacgtgggcctcgagtctaggacgacggagtctagtattattacngcagtcctanatgtgtcgtagtttcgttccttattacaagtnttaacggtcgggcgggtaaggaccgagtcttcggaccgttctgtagtcacgccgaggtcccgttcccgtccccg

SEQ ID NO: 317087 - DNA, 603 bp, Homo sapiens
  misc_feature: GZ8MTXP01EEFYC.9.21.B10.1.454.CMB.2.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (444)..(444): a, c, t, g, unknown or other
  misc_feature (444)..(444): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccaccactgatatggctattataacttgtctctgtancaacaacnccagacaaacnccccacactacttaattatgtagtacacaacgccgtccctcgtagggttctggtctctctctcgcctactagtcgtacggacaaccgacgtccctacccgtcactactcgtcgtcggtcctactacgtctaggacgacggtagtctagtaattattacgtgcacggtntactagttactgtacgttaggtttcgtttccttacttacaaagtacgttagttcggggaacgggacggggtaaaccttcgggtaccgtcggttacccgttcgttacggaacgttaccgaaccgacccgacgttcccgtaacccgttcccccggtttccg

SEQ ID NO: 317088 - DNA, 554 bp, Homo sapiens
  misc_feature: GZ8MTXP01EQ5M1.9.21.B10.1.454.CMB.2.raw
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgacccagcctgcctccgtgtctgggtctcctggacagtcgatcaccatctcctgcactcgacccacactgatatggctattactaacttgtctctgtancaacaacgccagacaaacgccccacactcttaattangagtcactaagcgccctgtagggttctcggtcgtcttctcctcgcctacgacgtcgtacggaccaaccgaccggtccctccctacgaacctaactcctcgtacgggctaccgagtcgtgacgaacgaggtctgtaattatacgtgcagtctnaatntgctgttcgttcccttnttacaagtacttggtcgggcggaggaccnggctcgaccgttcttggaactcgaacgcccagggttcctccgttccccgtcg

SEQ ID NO: 317089 - DNA, 586 bp, Homo sapiens
  misc_feature: GZ8MTXP01EUTP4.9.21.B10.1.454.CMB.2.raw
  modified_base (391)..(391): a, c, t, g, unknown or other
  misc_feature (391)..(391): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatggctattatacttgtctctgatcaacacgccagacaaacgcctacccacacttcttaatttatgagtcactaacgccggtcctcgtagggtttctggtcgtccttctactcgccctcaaagtctcgacaacgcgcctcctagacactcgtcgnggcctacgagtcgtacgacgacgtagtcgtataactttactcgtacggctaacgtcctnaattcgtcgtacgtttacggtttcgttaccctttagttaccgaagtaacgttcggttcggggaacggacggtaacctcggggttaccttcggttacccgttgagtaacgtccgacgaccgtcggttcccgtccccg

SEQ ID NO: 317090 - DNA, 552 bp, Homo sapiens
  misc_feature: GZ8MTXP01B1LH8.9.21.B10.1.454.CMB.2.raw
  modified_base (287)..(287): a, c, t, g, unknown or other
  misc_feature (287)..(287): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctctgcactcgacccacactgatattgggctattataacttgtctcctgtatcaacaacgcccagacaaacgccccanactacttaattatgagtcactaagcgccctacgagggtttctggtcgtcttcctctgcctccaagtctgcaacacgccctaccctgacaatctcgtgctcatcctgacagagtcagtattatacgtgcgtanccttanatancgtcgtaggtttcgttccttacttacgaagttagttaacggtcgggacgggacggttaccgacggtccgttcggttccgttcgtaagacgtccgaccgaccgacggtcccgttcccgtccccg

SEQ ID NO: 317091 - DNA, 627 bp, Homo sapiens
  misc_feature: GZ8MTXP01CIGUA.9.21.B10.1.454.CMB.2.raw
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactcggacccacactgatagttgggactattataaccttgtctctgtatacaacacaccagacaaacgccccacactacttaatttangacgtacactaagccgccctgtagggtttctggtccgtcttcctctcgcctctaagtccaggcaaaccncggccctcccagaccaatctcgtcggctacgagttccngacgaccggtgccgtagtaacttactttacncggactacgtactacaagttactcgtacccgttaggttttccggttccctttacttttacgaaaagttcgttaacggtttccggggaccggggtaacgggaacccgtagggtcccgttcggttaccccgtttcgaacggtcgttaaccgacggtaccccgacggtcccgttcccgttccccccgg

SEQ ID NO: 317092 - DNA, 564 bp, Homo sapiens
  misc_feature: GZ8MTXP01DEB24.9.21.B10.1.454.CMB.2.raw
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (411)..(411): a, c, t, g, unknown or other
  misc_feature (411)..(411): n is a, c, g, or t
  modified_base (478)..(478): a, c, t, g, unknown or other
  misc_feature (478)..(478): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgatatggctattataaccttgtctctgtatacaacacgccaagacaaacgccccacactacttaattangagtacactaagccgtccctcgtagggtttctggtcgtcttcctctcgcctcaagtctagcaaacnccgcctcctagactaactctcgtcggctcgagtctagacgacgngtctagtacttatactgctacgtctactatagtcgtcgttagtttacgttcccttacttacgaagtnttaacggttcgggacggtacgggaccgacggtcttcggttcccgttccgtaagacgtcacggacccgaggtcccttccgtcccccg

SEQ ID NO: 317093 - DNA, 581 bp, Homo sapiens
  misc_feature: GZ8MTXP01EQXMN.9.21.B10.1.454.CMB.2.raw
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctctgtatcaacacgccagacaaacgcccccacactcttaatttatgagtacacgtaagccggcccttacgtagggggtttctggtcgtcttcctctcgccctacaagtctggccacaccgccctccctagacatctcgtggctccgagtcctaggaaccgacgngtctgatttagttacngactacgtctacatagtgtcgttaggtttcgttccttatttacgaaagtagttaacggtcgggacgggacggaccgacggtccttacggttacccgttcgtaaggacgtccgaccggacccgacggtccccgttcccgtcccccg

SEQ ID NO: 317094 - DNA, 534 bp, Homo sapiens
  misc_feature: GZ8MTXP01BKKUJ.9.21.B10.1.454.CMB.2.raw
  modified_base (282)..(282): a, c, t, g, unknown or other
  misc_feature (282)..(282): n is a, c, g, or t
  modified_base (364)..(364): a, c, t, g, unknown or other
  misc_feature (364)..(364): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattatactgtctctgatcaacacgccagacaaacgccccanactcttaattatgagtcactaagcgcctcgagggtttctggtctcttcctctgcctcagtctgcacacgcctcctgacatcncgtggctcagtctagacgtacgagctagtattagtactcgctagcttacattatcgtcgtagtttcggttcctatttacaaagttnttaacgttcgggcgggaggacccgtagggcttcggaccgttcgttaagcgttaacgcgtacccgaggtcccttccggtcccccg

SEQ ID NO: 317095 - DNA, 634 bp, Homo sapiens
  misc_feature: GZ8MTXP01BKYTQ.9.21.B10.1.454.CMB.2.raw
  modified_base (364)..(364): a, c, t, g, unknown or other
  misc_feature (364)..(364): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcgatcaccatctcctgcactcggacccacactgatagttggctattataaccttgtctcctggtactcaacaacgcccaagaccaaaccgccccacactacttaaatttatgtagtacactaaacgccggccctcgtacgggtttctggtcgtcgtttcccnctcgtcctaccaagtccgtgccgaaccaccgggccctccctagactaactctcgtcgggcctcgacgtctgaacgacgagtcgttagtacttattactcggctaacgtctaccattaagtcgtcgttacgtttcgggtttccttacgtttacaacgttagtaacgggttcggacggggtaacgggttaccgtaaccgggtcgttaccggttccggttccgtaaggtacgtccgaccggacccgaccggtcccgttccccggtccccccgg

SEQ ID NO: 317096 - DNA, 578 bp, Homo sapiens
  misc_feature: GZ8MTXP01ESK0S.9.21.B10.1.454.CMB.2.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (398)..(398): a, c, t, g, unknown or other
  misc_feature (398)..(398): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactcggacccacactgatagtggctattatacttntctctgatcaacacgccagacaacnccccacactacttaattatgagtcacgtaacgcccgtcctagtagggtttctggtcgtcttcctctcgcctcagtctagcacgacgcctcctgactatctcgtcggctcgagtcagacgngaggtctagtattaactacgtgacctagtcctatatatcgaactttggtttacgtttccttacgtttagaaagttataacgggttacggggcgggtaaccgggcgacgggtcgttaccggttacggtttcccgaagggtactccgaccggacccgttaaggtcccgttcccggtcccccg

SEQ ID NO: 317097 - DNA, 550 bp, Homo sapiens
  misc_feature: GZ8MTXP01CY7H6.9.21.B10.1.454.CMB.2.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgatcaccatctcctgcactggaccacactgatatgggcattataactgctcngatcaacaacgccagacaaagccccacactactaattangagtcaacaagcgccctcgagggtttcngtcgcttctctgacctccaagtctgcaaacaccggccttcccganacactctcgtcgctacagtcaggaacgacgagtactagtattactacncgacgacgtctactatagtgtcgtacgttacgttccgttcttacgtaagtagtaacggtacgggttacgggtacggacggtacggtacgttcgttccgttcgtcgtacgaacgacgaccgaccgtccgttcccgtcccg

SEQ ID NO: 317098 - DNA, 644 bp, Homo sapiens
  misc_feature: GZ8MTXP01DHHX2.9.21.B10.1.454.CMB.2.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcacatctctgcactcgacccacactgatatggctattatactntctctganacaacacnccagacaacncccacactacttaattangagtacactacgccgtccctcgtagggttctcggtcgtcttcctctcgccctcaagtctggccaaaccgaccggtccctacccgtacgaactaactcgtccgtcgggtcctccgtagtcgtacggaaccggtacggtacggtccttagttaactttacgttaacgtcgactacgtctactaagttacgtcgtacgttacggttttccggtttcccttagtttaaccgaaaggttcgttaacgggttccggggaccggggtaaacgggacccgtacgggtaccgttacggttacccgttacgtcggtaacgtccggaccgtacccggaacggtcccgttccccggtccccccg

SEQ ID NO: 317099 - DNA, 572 bp, Homo sapiens
  misc_feature: GZ8MTXP01BOE5P.9.21.B10.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggctattataaccttgtctctgatcaacaacgaccagacaaacgccccanactcttaatttangagtacactagccgccctcgagggtttctggtcgtcttcctctgcctccaagtctgcacacgccctcctgacatcctctcggctccagtctgacgacgaggctagattactactgcagtctacatatggctaggtttcggttcccttnttacgtaagtacgttaacgttcgggacggggaacgggttaccgaacgggtccttacggttacccgttccgtaagggacgttaacgaccggacccgaacggtccccgttccggttccccccgg

SEQ ID NO: 317100 - DNA, 576 bp, Homo sapiens
  misc_feature: GZ8MTXP01DY3AT.9.21.B10.1.454.CMB.2.raw
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcgacccaccactgatattggctattataaccttgtctctgtatacaacaacaccaagaccaaaccgccccactactacttaatttatgagtacacgtaacgccgtcctcgtagggtttctggtcgtcttcctctgcctccgtaagtctacgcaacgacccgtccctaccctgaactacttctcgtggcctcngtctagacgacgngctgtattatactgactagtctactaatgtcgtcgttaggtttcgtttccttatttacaagttagtaacgttcggggacgggacgggttccgaggtcgttacgttccgttcgtgtacgcgtcgacccgacggtcccgttccggtcccccg

SEQ ID NO: 317101 - DNA, 697 bp, Homo sapiens
  misc_feature: GZ8MTXP01B9PT5.9.21.B10.1.454.CMB.2.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgatcacatctctgcactcggacccacactgatagtggctattatacttgtctctgatcacacgccagacaacgccccacnctacttaattntgacgtacacgtagcgcctcgtagggtttctggtcgtcttcctctacgcctaccaagtctacggaacaaccgacccggtccctacccgtagaacctaacttccctccgttcggggtcctccgtaacgtccgttacggaaccggtaaccggacgggttctaggttaaactttacgttaacgtcggtacacgtacttacacgtttaatcggttccgttaacggttttccggtttacccttaccgttttaacgtaaacgttacggtttaacggttacccgggggttacgggggtaaacgggacccgtaaacgggggtcccttaccgggttaacccgttccggttaacggtacggttcccgtaaaccgggaccccgttaaacggtccccgttccccgggttcccccccgg

SEQ ID NO: 317102 - DNA, 677 bp, Homo sapiens
  misc_feature: GZ8MTXP01C0G0K.9.21.B10.1.454.CMB.2.raw
  modified_base (280)..(280): a, c, t, g, unknown or other
  misc_feature (280)..(280): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcacatctcctgcactcgacccacactgatatggctattataccttgtctctagatacaacacgaccagaacaaccncccactacttacttaattatagacgtacacgtacgccgtcccgtcgtagggtttctcggtcgtcttccctctcgtcctaccgtaacgttccgtacgaacccgtaaacccgtacccggtaccccttacccgtacgaacctaaacgtcccgttacgtcggggtacccttaccggtacgttaccgtacgggaaaccggtacggtaggtaccttagttaaactttacgttaaccgtcgactacgtacctataacgttagtcgtcgttaggtttccttccttacgtttaccgaagttcgtaacgggttccggggcgggaaacggacccgtagggtccttaacgggttccgttcctaagggtacgtccgaccggtacccgacggtcccgttcccgttcccccg

SEQ ID NO: 317103 - DNA, 613 bp, Homo sapiens
  misc_feature: GZ8MTXP01A02PM.9.21.B10.1.454.CMB.2.raw
  modified_base (288)..(288): a, c, t, g, unknown or other
  misc_feature (288)..(288): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
  modified_base (573)..(573): a, c, t, g, unknown or other
  misc_feature (573)..(573): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacaggtcctgggccctgtctgccctgactcagcctgcctcgtgtctgggtctcctggacagtcgatcaccatctcctgcactcgacccacactgatatggactattataaccttgtctctgactacaacacgccaagacaaaccgccccanactacttaatttatcgacgtacacgtacgccgccgtgtacgggtttctggtcgtcttcctctgcctaccgtaagtccgttacggccaacgtaacccgggtccctaccccgtgtaacgaacttccgtcgttcgggcctaccgngtacctagaacgtacggacgtntacgtattacgttactcgactacgtccttanacgttaagtcgtacgtagttttcggtacccttcgttactaaaggtctaaacggttcgggcgggtaacgcgaggtcttacgttacgttccnggtactccgacgaccttacgggtccttccgtaacccccgg

SEQ ID NO: 317104 - DNA, 578 bp, Homo sapiens
  misc_feature: GZ8MTXP01A30SB.9.21.B10.1.454.CMB.2.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataaccttgtctcctgtatcaacacgccagacaaacgccccacactcttaatttangaggtcactaagccgcctcgtaggggtttcnggtcgcttcctctgccctcaagtctggcaacaccgccctcctgacatctctggctcagtctgacgacgaggctgattacttactgacagtctacattactgtcctaaggtttccggtttcctccgttttacgaaacgtagttaacggttcgggacgggacgggttacccgaagggtcgttacggttacccggttcccgtggtacgtcgaaccggccccgaaggggtccccttcggtcccccccg

SEQ ID NO: 317105 - DNA, 713 bp, Homo sapiens
  misc_feature: GZ8MTXP01BFCUR.9.21.B10.1.454.CMB.2.raw
  modified_base (255)..(255): a, c, t, g, unknown or other
  misc_feature (255)..(255): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatatgggctattataaccttntctctgatacaacaacgccagacaacgccccacactcttaattatgagtacactagccgccctcgtacgggtttctggtcgtctcctctcgccctacaagtccgtaggccaaccgaccggtcccttccctacgaacctacttcctccgtgggtcccttacccgaggttccgtacggaaccgggtaacgtacgggtacgttacggtaacttttaacttaaccgttcgaccggaacggtacccttacctaaagtttaacgtcggttacccgtttacgggttttccggttttacccttaacccctttttaagaaaaccggtttaacgttaaacggggtttcccgggggaacggggaccgggttaacccgtagggtcccgttacgggttacccggttccgtaacgggccgtaacgtaaacccgggccccgttaacgggtccccgtttccccggtccccccgg

SEQ ID NO: 317106 - DNA, 563 bp, Homo sapiens
  misc_feature: GZ8MTXP01D92RA.9.21.B10.1.454.CMB.2.raw
  modified_base (291)..(291): a, c, t, g, unknown or other
  misc_feature (291)..(291): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctccaccctcctcactcaggacacagggtcctgggccctgtctgccctgactcagcctgcctcgtgtctggtctcctgacagtcgatcaccatctcctgcactcgacccacactgatatggctattatactgtctctgatcaacacaccagacaacgccccacactacttattangagtcactacgcgtcctcgtaggttctgtcgtcttcctctcgcctacagtcngcacgaccgtccctcctagactatctcgtggcctcngtcgagacgacgagctagtattatactgactagtctacattagcgtgttacgtttccggttccttaccgtttaagagtacgttaacggttccggggaacgggtaccgggttacccgagggtcccgttacgttcccgttcgtggtacgtccgacgtacccggacggtccgttcccggttcccccg

SEQ ID NO: 317107 - DNA, 626 bp, Homo sapiens
  misc_feature: GZ8MTXP01D4CZM.9.21.B10.1.454.CMB.2.raw
  modified_base (288)..(288): a, c, t, g, unknown or other
  misc_feature (288)..(288): n is a, c, g, or t
  modified_base (330)..(330): a, c, t, g, unknown or other
  misc_feature (330)..(330): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgccctcgtgtctgggtctcctggacagtcgatccaccatctctgcactcgacccacactgatattggctattataaccttgtctctgatcaacaacgccagacaaacgccccanactattaattatgagtcactaacgcgccctcgtagggtttcnggtcgtcttcctctcgtcctctaacgtcctaggccaaccgaccggtcccttacccgtacgaacctaacttcgtccgtgggccttaccgagttctaggacgaccggagtcgtagtaacttaacttacttcggacgaacgtcttaccagttatcggtacttaggtttacggtttcccttacgtttacctaagtactaacggttcgggacgggtacggaccgtaaggtccgttaacggttccgttacccgtaaggtacgtccgaacggccccgaacgggtccccttccccggtcccccg

SEQ ID NO: 317108 - DNA, 725 bp, Homo sapiens
  misc_feature: GZ8MTXP01DM7E1.9.21.B10.1.454.CMB.2.raw
  modified_base (298)..(298): a, c, t, g, unknown or other
  misc_feature (298)..(298): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcacatcctctgcactcgacccacactgatattggactattataacttgtctctgatcaacacgccagacaacgccccacactacttaattangtacgtacactaacgccggccctcggtagggtttctggtcgtcttccctctcgtccctaccgtaacggttccgtacggaaccaaaccgacccgggtccccttccccgtacggaaccctaaacttccgtaccgttcggggtacccttcccgtaaggttcccgttaacgggaacccgggtaaaccgggtacgggtaccttaagggttaaacttttaaacttaccgttacgggacctaacggttacccttactaaacgtttaagttcggtaccgtttacgggttttccgtttacccttagttttacgaaacgtttagttaacggttcggggaccggggtaacgggaccgacgggtccgttccggttacccgtttccgaagtaccggtccaccggtacccgaccgggtcccgttccccggttcccccccgg

SEQ ID NO: 317109 - DNA, 574 bp, Homo sapiens
  misc_feature: GZ8MTXP01E0UOJ.9.21.B10.1.454.CMB.2.raw
  modified_base (427)..(427): a, c, t, g, unknown or other
  misc_feature (427)..(427): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggatcaacaacgcccagacaaagccccccacactcttaatttatgaggtcactaacgccggtcccctgtagggggtttctggtcgcttcctctgccctcaagtctggcaacacgcctcctgacatctctgggctccagtctgacgacgagctagatttaattccngcgacgtctacagtacgtgcgtgttcgttccgttccttacgtaacgaagtaacgtacggttacgggacgggaccggtacgtacggttccgttccggttacccgtcgtacgtaaccgtacgacccgaccgtaaccgttcccgtccccg

SEQ ID NO: 317110 - DNA, 605 bp, Homo sapiens
  misc_feature: GZ8MTXP01DEJT7.9.21.B10.1.454.CMB.2.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctggccctgtctgccctgactcagcctgcctcgtgtctggtctcctggacagtcgatccacctatctctgcactcgacccacactgtatagtggctaattactacttgtctctgatacaacacgccagaccaacncccacactacttaattngagtacacgtagcccgtcctacgtaggtttctcggtctccttcctctcgccctaccaagtccgtcgcctaaacgcccgtccctccacgactatccctcgtcggcctcgtagtccgtaggacgacgtagtctagtaacttnttacncgactacgtcctanattgtcgtcgttaggtttccgttcccttaagttacaaagttcgttaaggttcccgggacgggtacggacccgtaggtccttaacgttcccgttaccgtggaaaccggtccaccgggaccgttaaccgggtcccttccccgtcccccgg

SEQ ID NO: 317111 - DNA, 561 bp, Homo sapiens
  misc_feature: GZ8MTXP01C2D8N.9.21.B10.1.454.CMB.2.raw
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggcagtcgatcacatctctgcactcggacccaccactgatatgggctattataaccttgtctctgtatcaacacgccagacaaacgccccacactcttaattatgagtcactaagcgtccctgagggtttctggtctcttcctctcgcctccaagtctaggccaaacncggcctcccagacatctctggctcagtctcgacgacgagctgattattactgncgtctacatatgctagttcggttcttcgtttacaagtattaacgttcggcggtaacgggacctgggtaaccttcggacccgttccgttaacggacgttcccgaacggaccccgttaaacgggtcccgttaacccgttcccccccgg

SEQ ID NO: 317112 - DNA, 570 bp, Homo sapiens
  misc_feature: GZ8MTXP01D0URE.9.21.B10.1.454.CMB.2.raw
  modified_base (265)..(265): a, c, t, g, unknown or other
  misc_feature (265)..(265): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaacctcctcactcaggacacagggtcctgggccctgtctgccctgactcagcctgcctcgtgtctgggtctcctggacagtcgatcaccatctcctgcactcgacccacactgatatggctattatacttgtctctgatcacacnccagacaacgccccacactacttaatttatcgaggtacactaagccgtcctcgtagggtttctggtctcttcctctcgtcctcaacgtctcgcacaccgccctccagacatcncgtggctacngtctgacgcgtagtctagtattatactgacgatctacatatcgtcttaggtttcgtttcccttacgtttacaacgttgtaacggttcgggacgggaacgggttacccgagggtccgttcgttacccggttcgtaacggtacgtccgaccggtacccgaacgtcccgttcccgtccccccggg

SEQ ID NO: 317113 - DNA, 605 bp, Homo sapiens
  misc_feature: GZ8MTXP01AHI0P.9.21.B10.1.454.CMB.2.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcacgtgacccacactgatagttggctattataaccttgtctcctgatcaacacnccanacaacgccccanactcttaattatgagtcactaagcggtacctcgtaggggtttctggtcgtccttctctgcctccgaagtctggccaacgccgggccctcccgtgaactaactctccgttgggcccttacgacgtctacggacgtacggaggtcctagttacttatttaccgnacgtactctactagttctcgtcgttaggtttccgttcctttacgttacgaagttcgttaacggtccgggacgggtaacggttccgaggtccgttacggttccgttcgtaacggtacgtaaccgtaccggacccgttacgtcccgttcccgtccccg

SEQ ID NO: 317114 - DNA, 713 bp, Homo sapiens
  misc_feature: GZ8MTXP01D8EU1.9.21.B10.1.454.CMB.2.raw
  modified_base (299)..(299): a, c, t, g, unknown or other
  misc_feature (299)..(299): n is a, c, g, or t
  modified_base (381)..(381): a, c, t, g, unknown or other
  misc_feature (381)..(381): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatccaccatcctcctgcactcggaccccacactgatagtggctattatactgtctctgatcaacacgccagacaacgccccacactacttaattntagacggtacacgtaagcccgtccgtgtagggtttctgtcgtcttcctcctcgtacctccaacgtcgtacggcccgaaaccncccgggtaccccttccccgtagtaaccctaacgttcccttacgtcggggtaccctccgtacgttccgtacggaaaccgggtacgtagggtcctaaggttatttaacgttacgtcgtacgtacgtacttactacgttaacgtgtccgtttacggttttacccggttttccttacccgttttaagtaaccggtttaagttaaccggtttccgggggaaaccggggaccgggttaaacccgtagggtacccgttaccgggttaaccccgttcccggtggtaacccgtcgtaaccccggacccgaacgggttccccgttaaccccgttccccccgg

SEQ ID NO: 317115 - DNA, 631 bp, Homo sapiens
  misc_feature: GZ8MTXP01DORX2.9.21.B10.1.454.CMB.2.raw
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacgagggtcctgggccctgtctgccctgactcagcctgcctccgtgtcgtggtctcgtggacagtcgatcacatctctgcactcgacccacactgtatagttggactaattactaacttgtctcgtgtacacaacaacgccaacgaaccaaaccgccccaactacttacttaaattagagacgtactacgtaacggccgtcccgttggtacgggttctcgtcgtcttctcctcgtcctacgtacgtcgtaacggacctaacgccgtacctccctagactacgtcgtcgtcgtctacgtagtctacgacgacgagtctagtaattcgtagtcgcaaggtcctagtaattacgtcgtacgtttacgggtttcgttacccttgttaaacgaaagttcgttacgggtaacgggacgggttaacggaccgttaagtccgtacgttaccgttcaggtaaccgtacaaccgtacccggacgttcccgtcccgttaacccccggttg

SEQ ID NO: 317116 - DNA, 625 bp, Homo sapiens
  misc_feature: GZ8MTXP01D7QUI.9.21.B10.1.454.CMB.2.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
  modified_base (557)..(557): a, c, t, g, unknown or other
  misc_feature (557)..(557): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgcgtctcctggacagtcgatcaccatctcctgcactgaaccngctagttggtatttactgtctctgtaccaacaccaccagaccaaacgcccaaatcatcgtaatttanagaagtcaacgtaaggccgtacccgtgggtactttcngtcttcgtcttcgtctccggcctacgaagtccctacaaaaccnccgcctcctagactatctgtcggctccgagtcgtaggacggaccgaggtacttactaatttacgtacgttagttcacttaactaaggttaactaacggtaggttaagttaaggttacggttgggttacggtacggcggtaacgggacaagtcgtaacgtaccgttcgtaaacgttccgaaacnccgttaacggccttccgtcccccgtaggtccttaaccgttccgttaccgtttcccccgaaccgttccg

SEQ ID NO: 317117 - DNA, 580 bp, Homo sapiens
  misc_feature: GZ8MTXP01BHXSD.9.21.B10.1.454.CMB.2.raw
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctctgcactcgacccacactgatattggactattatacttgtctctgatcaacacgccagacaaacnccccanactctaattngagtcatagcgcctgaggttcnggtcgtcttcctctcgcctacagtctacgcaacgccgcctcctgacatctcgtgctcgatcgtgacgcgagctagtattagtactgctagtctacattactgacgttagtttcggttccttacgttacgtaacgttagttaacggtccggggttacgggtaaacgggttaccgtacggtccgttaaccgggttcccgttaccggttcgaccggttcccgaaccgggtaccccgaaacggttccccgttccccggttccccccgg

SEQ ID NO: 317118 - DNA, 554 bp, Homo sapiens
  misc_feature: GZ8MTXP01CU2N1.9.21.B10.1.454.CMB.2.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactcgacccacactgatagtggactattatactgtctctgatacacacgccagacaacncccanactnttaattngagtcactacgccgtcctgtagggttctcggtctcttcctctcgtcctcaacgtctacggccaaccgaccgtccctccgtagactactcctcgtcggcctacgngtctcgacgacgagtctagtacttattcgnccgtancttacatgtgacgttgtttcgttccttattacgaagttgttaacggtcgggcgggacggaccgaggtcgttacgttccgttaccgtgactcgaccgccgacgggtccttcccggtaaccccg

SEQ ID NO: 317119 - DNA, 647 bp, Homo sapiens
  misc_feature: GZ8MTXP01B82AA.9.21.B10.1.454.CMB.2.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcgacccacnctgatagtggactattatactgtctctganacaacacnccagacaacnccccanactacttaattangagtacaacgtaacgtccgccctcggtacggtttcgtcgtccgtcttccctctcgccctaccgagtccgtacgcaaaccgtacccggtccctaccctacgacctaactccctcgttcgggacctcctaaggtctacggacgtagcggtactagtattacgttacgcgtacggtactacctctaagtagttccgaacgtttcggtttttacccggtttccctttagtttaaccgaaaggtttcgttaacggttcggggacgggtaaacgggttcctacgggtcgttaccgttaccccgttgtaacggacgttcgaccggtaccgttacgggtcccttaaccccggtcccccg

SEQ ID NO: 317120 - DNA, 536 bp, Homo sapiens
  misc_feature: GZ8MTXP01AOQ7C.9.21.B10.1.454.CMB.2.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccccaccactgatattgggctattataaccttgtctcctgatcaacacgccagacaacgccccanactcttaattangagtcactaagccgccctgtagggtttctggtcgtcttccctctgccctcaagtctcggcaacaccggccctcctgacatctcgtggcctccgattcngacggacgaggctgtattactactgacganctcattangtctagtttcgtcttcgttanaagtntaagtcggcggtacggaccgtgggcttacggccgttctgactccgacgaccgttagtccgttccgtccccg

SEQ ID NO: 317121 - DNA, 697 bp, Homo sapiens
  misc_feature: GZ8MTXP01AF14Z.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccccaccactgatattggctattataccttgtctctgatcaacaacgccagacaacgccccacactcttaattatgaggtcacgtaacgccggtccctcgtagggggtttctcggtcgtcttccctcgtcgtccctacctaacgtcgttacggccaaaccgacccgggtccctcccccgtaggaaacctaacttccgtaccggttcgggtcctccgtaacgttccgtacggacggaacggagtccgtagttaactttaacttacgtcgactacgtctacctaagtattcgtcgttaacggttttcggttcctttacccgtttaagtaaacgttaagtttaacggttccggggaggggtaaaccgggacccgtaacgggtaacccgttcggttaaccccggttccgtaaggtaccggttaaccgacccgggacccggttaaccgggtcccgttcccccgggttccccccggg

SEQ ID NO: 317122 - DNA, 543 bp, Homo sapiens
  misc_feature: GZ8MTXP01ELBYG.9.21.B10.1.454.CMB.2.raw
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatcaccatctcctgcactcggacccacactgatntggctatataactgtctctgancaacaacgccagacaaacgccccanactacttaattangagtcactagccgcctgtaggtttctgtcgtcttcnctgcctacagtcngtcaacacgcctccgtanacatctntggctcgagtctagacgacgtaggctagattatacgngacgagtctanagtcgtcgtacgttacgtttcttacttattacgaagttgtcggtcgggacgggacggacgtacggtcgttacgttccgttacgtgtaccgtaacgaccgtaccgttacgtcccgttcccgtccccg

SEQ ID NO: 317123 - DNA, 722 bp, Homo sapiens
  misc_feature: GZ8MTXP01CRZB3.9.21.B10.1.454.CMB.2.raw
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcacatcctctgcactcgacccacactgatagtggactattactacttntctctgatacaacacgccagacaaacgccccanactcttaattngacgtacactaacgccgtcctgtagggtttctggtctcttcctctcgtctaccgtaagtcctaggtaaccaaccgtacccggtcccttacccgtagtaacctaactcccgttacgtcggggtaccttacccggtagttccgtacggaaccgtacgggtacgtaccgtagttaacttaacgttacgtacggtacctaacggtacccttaagtaaccgttagtaccgggttaccgtttaacggttttacccgggttttaccctttacggttttaaacccggaaaggtttacggttaaccggggttaaccggggaacgggggttaacccgggaaccggtaacgggtcccgttacgttaccccgggttcgttaacggaccgttaacggacccggtaccgaaccggtcccgttcccggttaacccccgg

SEQ ID NO: 317124 - DNA, 602 bp, Homo sapiens
  misc_feature: GZ8MTXP01D53VM.9.21.B10.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactcggacccacactgatattgggctattataccttgtctctgtatcaacaacgccagacaaacgccccanactacttaattangagtcactaagcggtccctcgtagggtttctggtcgcttctctcgcctcagtctgcaacncgcctccctagacaatctctaggctcagtccgtagaccgtacgaggtctagatttactactacgcaacgtcttacctattaagtcgacgttacgtttacggttcctttacgtttacaagtacgttaacgttcgggacggggaaggttaccccgtaaggtcccgttaacgggcccgttacccttaagggaacgttccgacccggtacccgttaaccggggtcccttcccggttcccccccgg

SEQ ID NO: 317125 - DNA, 753 bp, Homo sapiens
  misc_feature: GZ8MTXP01EU9OQ.9.21.B10.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcatcaccatctctgcactcgacccacactgatagtggctattataaccttgtctctgactacaacacnccagacaaacgccccanactacttaattatgaggtacaacgtaacggcccggacccttcggtacgggggttttctcgggtccgtcctttcccgtccttcgtaccctacccgtaaacggttccgttacgggaacctaaacccgtaacccggggtacccccttacccccgttacggaacccctaaacgtttcccgtacccggttacggggtcccttcccgtaaacggttccgtacggtaacccgggtaacggtacggggtaccttaggtaaactttaacgttaactcgtacgtacgtacctactaacttacgtcgacgtttacggtttcggtttccttacgtttacaaggttaagttaacggtttcggggacgggtaacggttacccgtaacggtccgttacgggttcccgttccggtttaacggaccggttaacccgaacccggtccccggttaaaccggtccccgttcccggttccccccccggg

SEQ ID NO: 317126 - DNA, 553 bp, Homo sapiens
  misc_feature: GZ8MTXP01EDEJJ.9.21.B10.1.454.CMB.2.raw
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (472)..(472): a, c, t, g, unknown or other
  misc_feature (472)..(472): n is a, c, g, or t
  modified_base (529)..(529): a, c, t, g, unknown or other
  misc_feature (529)..(529): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgatccaccatctctgcactcggacccacactgatatggctattatacttgtctctgatcaacacgccagacaacgccccanactctattatgagtcactaagccggcctcgtagggtttcnggtcgtcttccnctcgcctcaagtctagggcaacgcccgtccctcccgtagactaactctcgtcggcctcgagtctgaacgacgaggctagtattactactgcacgtctacatactgtcgttagtttcggttccttaccttagtaacgtnttaacggttcgggacgggtacggaccgtaggtccgttcgcccgttaccgtgacgtcncgaccgacgtccgttccgcccccg

SEQ ID NO: 317127 - DNA, 588 bp, Homo sapiens
  misc_feature: GZ8MTXP01BYOEZ.9.21.B10.1.454.CMB.2.raw
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcgacccaccactgatagtggactattactaacttgtctctgtacacaacacgccagacaacgcccccatactacttaattatgacgtcacgtaacgccgtcccgtcgtacgggtttctggtcgtcttcctctcgcctacagtctacggacaacgccggccctaccctacgactaactcgtccgtggcctaccgngtcgtgacgacgacggtcttagacttatactgcaggtcttntaactgtgtacgttgtttccggttacctttacttacgaaagttcgttcggtaaccggggacgggttacggaccgaggtccgtcggttccgttcgttggaacgtcaacggaccctacggccgtcccgttccccgttcgg

SEQ ID NO: 317128 - DNA, 684 bp, Homo sapiens
  misc_feature: GZ8MTXP01ES4JV.9.21.B10.1.454.CMB.2.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctagcctcgtgtctgggtctcctggacagtcgatcaccatctcctgcactcgacccacactgatagtggactattataaccttgtctcctgtanacaacacgccagacaaccgccccatactcttaattangagtacactacgccgcctgtaggtttctggtctcttccctctcgtacctcctaacgtctacgggaacaaaccgcccggtccctaccctacgaactacttccgtcgtacgggtcctacccgtaagttccgcggaaaccggacgtaggtaccttatactttaacttacgcgatacgtcttacattacgtcgtaaccggtttagtttcccggtttacttaccgtttaaacgtaacggttagttaaacggggtttccggggaacggggaacccggggttaaccggaaaccgtcggttaaaccggttcccggtttacccggtaagggaccttaacccggaaaccggtccccgaacgggttccccgttccccgggttccccccggg

SEQ ID NO: 317129 - DNA, 837 bp, Homo sapiens
  misc_feature: GZ8MTXP01EODPQ.9.21.B10.1.454.CMB.2.raw
tcagtgatacgtctcacgaccggtgctcgatttagtgtcgtcgcaagagaggagggggggggtcacaagaggcagcactctcgggacgtctccaccatggcctgggctctgctgctcctcaccctcctcactcaggacacagggtcctgggccctgtctgccctgactcagcctgcctcgtgtcgtgggtctcctggacagtcgactcaccatctcctgcactcgacccacactgatagtgggactattactaaccttgtctcctaggtactacaactaaccgccaacgaaccaaaaccgccccctaacgtaccttactttaaagtttacgtgtaacggttaacctaacgtaacggccccggtaccgtttacggttacgggggttttcctcggggttccgttcctttcccgtccgttacgtacccgttacctaaacgggtttcccgttacgggaaccctaaacccgggtacccgggtaccccggtttcccctaaggtaaacctaaaccgttccgttacccggtcgggggtaccccttaccggtaacgggttacccgttacgggaaacccgggtaccgggtaacggggttcccttaaggttaaacttaacgttaccgtaggtactacggtaccttaccgtattacggtcgttacgtttaacgggttttccggtttaaccttcctttaaaggtaaacggtttcttaaacgggttccgggggttaggggtaaacccgggttaccggtacgggtaccgttaccggttacccgttacggttaaggaccgttaacccgacgggtacccgttaaccgggtcccgtttcccggttaacccccggg

SEQ ID NO: 317130 - DNA, 626 bp, Homo sapiens
  misc_feature: GZ8MTXP01CIAOH.9.21.B10.1.454.CMB.2.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctccaccctcctcactcaggacacagggtcctgggccctgtctgccctgactcagcctgcctccgtgtctggtctctggacagtcatcacntctctgctactcgacccactactgtatagtggactattatactntctctgatacacacaccagacaaccncccactactacttaattatagtacgtacactacgccgtccgtcgtacggttcgtcggtctcttaccctctcgtcctctacgtacgtcgtccgaccgacccggtccctcccgagtacccccccctaatccgttcgtcggtccgtaccgtacgtaccgtacggtacgacgggtacgtacgtagttaacttacttacgtcgtacggtactactacctagtactgttaccgttacggtttcggtttaccttacgttaacgtacgttagtaacggttacggacggggtacggacgtcggtacgttccgaccgttcgtgtacgcgtaccgacgttacgtccgttccgtccccg

SEQ ID NO: 317131 - DNA, 613 bp, Homo sapiens
  misc_feature: GZ8MTXP01B3QE5.9.21.B10.1.454.CMB.2.raw
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactcgacccacactgatagtggactattactaaccttgtctcctgactacaacacgccagacaaccgccccanacttacttaattatgagtacactacgccgcctgtaggttcngtcgtcttcnctgcctactagtctgccaacgccgtcctccagactactctcgtacggtctcgagtcctagaaccggacgtaggtacttagtaactttacttacgtgcgaacgtctaactagtgtacgtcgttaggtttcggttacccttattttaccgaaagttcgttaacgggttccgggacgggaaacggttccgtacggtccgttaccggttaccgttccggttaaggcgttaaccgaaccggtaccccgttacgggtcccgttccccggttcccccgg

SEQ ID NO: 317132 - DNA, 557 bp, Homo sapiens
  misc_feature: GZ8MTXP01CX76N.9.21.B10.1.454.CMB.2.raw
  modified_base (297)..(297): a, c, t, g, unknown or other
  misc_feature (297)..(297): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcgatcaccatctcctgcactcggacccacactgatatgggctattatacctgtctcctgatcaacaacgccagacaacgcccacactcttaattangagtacactaacgcgtccctcgtagggtttctggtcgtcttcctctacgtcctaccgtaagtccgtgccctaacgacccggtcctaccctagactaaactcgtcgtggctccgagttcagacgacgtaggctagacttagttactcgcngtctctatagtgctgttcggttcttccgttataagtataagttcggacgggacgggacgaacgtcgttcgttacgttcgtcgtcgcgcgaccgacgtcgttccgtccccgg

SEQ ID NO: 317133 - DNA, 688 bp, Homo sapiens
  misc_feature: GZ8MTXP01B1CJZ.9.21.B10.1.454.CMB.2.raw
  modified_base (91)..(91): a, c, t, g, unknown or other
  misc_feature (91)..(91): n is a, c, g, or t
  modified_base (538)..(538): a, c, t, g, unknown or other
  misc_feature (538)..(538): n is a, c, g, or t
  modified_base (650)..(650): a, c, t, g, unknown or other
  misc_feature (650)..(650): n is a, c, g, or t
tcagtgatacgtctcacgaccggtgctcgatttagtgtcgtcgcaagagaggagggggggggtcacaagaggcagcgctctcgggacgtcnccttaccatggcctgggctctgctgctcctcaccctcctcactcaggacacagggtcctgggccctgtctgccctgactcagcctgcctcgtgtctggtctcctggacagtcgatcacctatctcctgcactcggacccaccactgtatattgggactattataaccttgtctctgtactcaacctacgacctagaacaaccgcccccaactacttacgttaatttatagaacgttacacgtaaacgcccggtacccgttcgtaacgggggttttcctcgggtcctcctttcctccgtacgcccttaccgacgtcgtacggccctaacgaaccgggtcccttaccctaggacctaaatccgtgtacgggccttcgtacgtacgtcgaacggtacgacgtcttaggtactttaatttaccgactacgtacgtactacgtaatttacgngtaacttacggtttacgtttccctttaggttactaaaggtcgttaagttcccggggaagggtacgggacctacggggtccttacggttaccccgttcgtaacggttcgaacnccggggaccccttaagggtcccttccccggtaaccccg

SEQ ID NO: 317134 - DNA, 796 bp, Homo sapiens
  misc_feature: GZ8MTXP01D8RDE.9.21.B10.1.454.CMB.2.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgttctgggtctcctggacagtcgactccacntcctctgcacgtacgacccacntagtattagtggactattactaaccttgtctctagatacaacacaccaagaaccaaaccgccccaactacttactttaaactttagtaggtaacgtacaacgttaacgccccggtaccctcgggttagggtttcctgggtcccttcctttctccggttactcccctacgtaaacggtttcccgacggtaaccgaaaccgtcccggggtaccccttacccgttagaaccttaaagttccgttcgtcgggtcctaccgtaacgtttcgtacggaaaccggacggtaccggtacttaaggttaacgttttaacttaacggtcggaccggttaaacgtctttaaaccgtaaactttaggttaccggcgtttttaaacgggtttcccggttttttacccttaccgggttttaaacctaaaggtttaaccggttaacggggtttaaccgggggacgggggtaaacggggttactaaaccgggggttccttaaacccggttccgttacccggttaagggacttaaccggaccgacccgttaacgggtcccgttccccggttccccccgg

SEQ ID NO: 317135 - DNA, 673 bp, Homo sapiens
  misc_feature: GZ8MTXP01EWCR2.9.21.B10.1.454.CMB.2.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgtcctgactcagcctgcctccgtgtcgtggtctcctggacagtcgatcaccatctcctgcactcgacccacactgatatggctattataccttgtctctgatcaacacgccagacaacgccccanctacttaattangacgtcacgtacgccgcctgtagggtttctcggtcgtcttccctctcgccctacaacgtcgtacggccaaaccgtcccgggtcccctcccgtacgtaacctacgttcctcgtcgggtcccttaccgacgttaccggtacggaaccggtacgtacgggtaccttaggtaaaccttttagttaacgttacggcctacggtacccttactaagttaacgtacggtcgttttaacggggttttccgttttacccttcgtttaaaccgaaggtacgttaacggtttccggggacgggaccggttacgaaacgggtcgttaccgttaccggttccgtaaggtacgtcaccgggtacccgagtcccgttcccgtaacccccggg

SEQ ID NO: 317136 - DNA, 545 bp, Homo sapiens
  misc_feature: GZ8MTXP01DM1NU.9.21.B10.1.454.CMB.2.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (468)..(468): a, c, t, g, unknown or other
  misc_feature (468)..(468): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcgatcacatctctgcactcgacccacactgatagtggctattatacttgtctctgancaacacnccagacaacncccatactcttaattnagagtacacgtacgccgtcctcgtaggtttcngtcgtcttcctctcgtcctacgaacgtcgtacgccaaaccgtcccggtccctacccgagactactcgtacgtggcctcgagtctagacgagagtntgtattatcgncagtctanagtatcgctagtttcgttccttgtacagtntaaggtcggacggtaaggccgtacggcttacgcccgttgcgtacgtcgacgtcccgacggtcccgttcccgtccccg

SEQ ID NO: 317137 - DNA, 730 bp, Homo sapiens
  misc_feature: GZ8MTXP01BBHCT.9.21.B10.1.454.CMB.2.raw
  modified_base (574)..(574): a, c, t, g, unknown or other
  misc_feature (574)..(574): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaacctcctcactcaggacacagggtcctgggccctgtctgccctgactcagcctgcctccgtgtcgtgggtctccgtggacacgtcgatccacctatcctcctgctacctcggaccccactactagtagtagttgggacttaattacttaaccttgtcctacgtgtaactacaaaccaaccgcccaacgaaccaaaccccgcccctaactacttacgtttaatttagtacggtaacggtacctaacgtaacggtccccggtacccgtttagggttacggggttttcctcggttcgtaccttttcccgccttcgtaccctaccgtacgttccgacgggtaaccctaaacccggtcccggtaccccttacccgtaacgtaaccgtaacgttcccgtaccgggtacgggtcctaccggtgttaccggagtacccggagtgtccgttatactttacnggttcacgggattctacgtattacgtcgttacgttaacggtttccttacttacctaagtaaagtcccggttaaggtcgggggaacgaccggttcgaacggttcgttccgacgttccgaacgggtatcccggacgacccgagtcccgccgtaacccc

SEQ ID NO: 317138 - DNA, 512 bp, Homo sapiens
  misc_feature: GZ8MTXP02IQUWO.9.21.B10.1.454.CMB.2.raw
  modified_base (227)..(227): a, c, t, g, unknown or other
  misc_feature (227)..(227): n is a, c, g, or t
  modified_base (369)..(369): a, c, t, g, unknown or other
  misc_feature (369)..(369): n is a, c, g, or t
  modified_base (409)..(409): a, c, t, g, unknown or other
  misc_feature (409)..(409): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggagttatgaccttgtctcctggtaccaacagcacccaggcaaagcccccaaactcatcattatgaggtcactaagcgccctcaggggttctattcgcttctctgctccaagtctgacaacacgcctccngacaatctctggctcagctgaggacgagctgattattacngtctgctacatatgcagatggtagactacgtcccggtggtacttcgggacggacggaccgaaggtcgaaccgtcgtaacggtcacgacccaagggtctcccgg

SEQ ID NO: 317139 - DNA, 514 bp, Homo sapiens
  misc_feature: GZ8MTXP02JPLOQ.9.21.B10.1.454.CMB.2.raw
tcagtgatacgtctcacgaccggtgctcgatttagtgtcgtcgcaagagaggaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctctggtatcaacaacgcccagacaaacgcccccacactcttaatttatgaggtcactaagcggccctcgaggggtttctggtcgcttcctctgcctccaagtctggcaacacggcctcctgacaatctctgggctccagtctgacgacgaggctgattattactgcagctcatatgctagttcgttctctttacaagtatagttcggcggacgggaccaggctacgaccgtctgacgtcacgcccaaggcctcggccccc

SEQ ID NO: 317140 - DNA, 585 bp, Homo sapiens
  misc_feature: GZ8MTXP02GFFLC.9.21.B10.1.454.CMB.2.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactggacccaccactgatattgggctattataaccttgtctcctgtatcaacaacgcccagacaaacgcccccanactcttaatttatgagtcactaagccggcctcgtagggtttcnggtcgcttcctctcgcctcaagtctggcaacacggcctccctgacatctctggctcagtctgacgacgaggctagtattattaccgngacatctanatatcgtacgttacgtttcgttccttacgtttactaaagtacgttacggtccggggacggggaacgggaccgtacgggtccgtaccggtacccgtccgtaaggtaccgtaccgacccggaccccggtaacggtccccgtaccccggtacccccg

SEQ ID NO: 317141 - DNA, 535 bp, Homo sapiens
  misc_feature: GZ8MTXP02H8B66.9.21.B10.1.454.CMB.2.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcatcaccatctcctgcactcggacccaccactgatattgggctattataaccttgtctcctggtatcaacaacgcccagacaaagccccanactcttaatttangagtcactaagcgcctgagggtttctggtcgcttccnctcgcctcaagtctcgggcaaacacggcctccctgacaatcncgtcggctccagtcngacgtagaggctgattatactgacagctanatatgctagttcgttcttcttactaacgagttacgtacggtcggacggtacggacgacgtcgtacgtaccgtcgtacgacgtcgaccgaccgtacgtcccgtcccg

SEQ ID NO: 317142 - DNA, 715 bp, Homo sapiens
  misc_feature: GZ8MTXP02GLY2G.9.21.B10.1.454.CMB.2.raw
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgccctcgtgtcgtggtcctcgtgacngtcactcactatcctctgcacgtcgacccacactgatagtggactattactacttgtctcgtgtatacaacaccnccagaacaaccgccccataccttactttaattataggtacgtactaacgtaacggcccgtcctcggttacgggtttcgtggtcgttcttcctcgtcgtccctacgtaacgttcgtcggaccaaccgaccggtcccttccgtacgaaactactccgttcgtcgggtccctaccgtagtcctacggaccgacggacggtcttagtaatttacgttacgtcggacacgtcctactaagttagtcgtacgtttaacggttttccggtttccctttacgtttaacgtaaaacgttaactttaacgggtttcccgggggaacgggggttaacccgggtaaaaccggacgggttccgtaaccggtacccccggtttcggttaacggaaacccggttccgtaacccgggaccccgtaaacggtccccgtacccccggtttcccccccggg

SEQ ID NO: 317143 - DNA, 503 bp, Homo sapiens
  misc_feature: GZ8MTXP02I6M94.9.21.B10.1.454.CMB.2.raw
  modified_base (301)..(301): a, c, t, g, unknown or other
  misc_feature (301)..(301): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagtgatacgtctcacgaccggtgctcgatttagtgtcgtcgcaagagaggaggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgccccaaatcatcatttangagtcactaagcgccctgagggtttctatccgcttctctggctcaagtctgacacacgcctcctgacaatctacgtggctccagctgagacgagctgattattacngtctgctcatagtgctaagngtgacactcgtcgtaggtacgtcggacggacggaccgtaggcgaaccgtcgtacggacacgacccgacgccgtccg

SEQ ID NO: 317144 - DNA, 545 bp, Homo sapiens
  misc_feature: GZ8MTXP02I964H.9.21.B10.1.454.CMB.2.raw
  modified_base (400)..(400): a, c, t, g, unknown or other
  misc_feature (400)..(400): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctgtatcaacaacgccagacaaacgccccacactcttaattatgagtcactagcgcctcgtacgggttctggtcgtcttcctctcgcctcagtctcgcaacacggcctccgtgacatctacgtggcctcagtctgacgacgnggctgattatactgcagtctcatatgactaggtttcgttccttctttacgaaagtattaacggttcgggacgggacggaccgacggtccgtacgcccgttcgtgtacgttacgaccggtacccgaacggtccgtaccgtcccccg

SEQ ID NO: 317145 - DNA, 584 bp, Homo sapiens
  misc_feature: GZ8MTXP02IR0HG.9.21.B10.1.454.CMB.2.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccanactcttaatttatgaggtcactaaagcggccctcaggggtttctggtcgtcttcctctcgcctccaagtctggcaacacggcctccctgacatctctggctccagtctgacacgagctgattattactgccagtctcagtatgctagtttggttccttcgtttacaaaggtattaacgtttcggggacgggaacgggtaaccgacggtaccgttcggaacccggttcccttaagggaacgttcccgaacggaccccccgtaaaacggggtcccctttaccggtcccccccccgg

SEQ ID NO: 317146 - DNA, 541 bp, Homo sapiens
  misc_feature: GZ8MTXP02FJ0C8.9.21.B10.1.454.CMB.2.raw
  modified_base (338)..(338): a, c, t, g, unknown or other
  misc_feature (338)..(338): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggctattataaccttgtctcctggtatcaacaacgcccagacaaagcccccacactcttaatttatgaggtcactaagccggccctcgaggggtttcnggtcgtcttccctctcgcctccaagtctggcaacaccggcctccctgacaatctctggctccatctgacgacgaggctgattattactgcagctacatatcgctagtttggttcctcgtttacaaagtatacgttcgggacggtacgggaccaggctacggacccgtcgtgacgtcgacgcccgaacggcctccgtccccccg

SEQ ID NO: 317147 - DNA, 559 bp, Homo sapiens
  misc_feature: GZ8MTXP02HTQTP.9.21.B10.1.454.CMB.2.raw
  modified_base (296)..(296): a, c, t, g, unknown or other
  misc_feature (296)..(296): n is a, c, g, or t
  modified_base (374)..(374): a, c, t, g, unknown or other
  misc_feature (374)..(374): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcactatctcctgcactggacccacactgatattggcattataaccttgtctcctggtatcaacacgccagacaaacgccccacactcttaatttangagtcataacgcgaccctcgtagggttctggtcgcttctcctgcctcaagtctggcacacgcctcctgactatcttcncggctcgatctgacgacgaggctgattactactgcagctcatatgtctaggttcggttcctctttaccgaagtagttacgttccgggacgggttacgggaacccgtagggtcctacggtaccccgtaccgttgaaccggttaccgaacgacccccgtaaagggcctaccggtcccgttcccccgg

SEQ ID NO: 317148 - DNA, 507 bp, Homo sapiens
  misc_feature: GZ8MTXP02HK0KK.9.21.B10.1.454.CMB.2.raw
  modified_base (282)..(282): a, c, t, g, unknown or other
  misc_feature (282)..(282): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccacactgatattggcattataaccttgtctcctgtatcaacacgcccagacaaacgccccanactcttaattatgagtcactaagcgccctcgagggtttctggtcgcttctcctcgcctcagtctggcacgacgcctccctgactatctctggctccagtctgacgagngctgtattatcngcagctnatatgcgtagttcgttccttcttacagtattagttcggacggaggtaccaggtctcgaccgtctagaacgtcgacgccgaaggcctacgtccccctcg

SEQ ID NO: 317149 - DNA, 612 bp, Homo sapiens
  misc_feature: GZ8MTXP02HWZ59.9.21.B10.1.454.CMB.2.raw
  modified_base (295)..(295): a, c, t, g, unknown or other
  misc_feature (295)..(295): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctccaccctcctcactcaggacacagggtcctgggccctgtctgccctgactcagcctgcctccgtgtctgggtctcctggacagtcgatcaccatctcctgcactcggacccaccactgatattggctattataccttgtctcctgtactcaacaaccgccagaacaaacgccccanactactttaattatgagtcacaagccgcctcgtagggtttctggtccgtcttcctctcgtcctacaagtcgtggccaaaccgaccggtccctaccccgtagaactaaactcctcgtcgggcctccgacgttctcgacgacgagacctagtattaagttactgacagtctacaatctgtctacggtttcgtccttacgtttacgaaagtacgttacggttacgggccggggaaacggtacccgaaggtccgtaccggtacccgttcgtaacgttcgaccgtaccggaacccgaaccggtccgtttcccgtccccccgg

SEQ ID NO: 317150 - DNA, 595 bp, Homo sapiens
  misc_feature: GZ8MTXP02GJ37X.9.21.B10.1.454.CMB.2.raw
  modified_base (295)..(295): a, c, t, g, unknown or other
  misc_feature (295)..(295): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccaccactgatattggcattataaccttgtctcctgtatcaacaacgcccagacaaacgccccacactctaattangagtcactaagcgccctcaggggtttctgtcgcttctcctcgcctcaacgtctgcacgacgcctcctgacactctctggctcagtctgacgacgaggtctgtattacttactgtcatctcataagtcgtcgtacggtttcggttccttcgtttaccaaagtacgtttaacgtttcgggaccggggttaaagggggacccgtaaacgggtcgttaccggaacccggtttccgttcggaaaccggttccgaacggtacccccgaaaaggtcccgtaccccggtacccccgtttaccccgggg

SEQ ID NO: 317151 - DNA, 688 bp, Homo sapiens
  misc_feature: GZ8MTXP02G70DM.9.21.B10.1.454.CMB.2.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccntctcctgcactggaaccngcagtgattggttgggattatgtaccttgtctccgtaggtaaccacacgaccacccgaaggaccaaaccgtaccccaaactctattagtaatttagaggtaacggtacaaagtaacggcccggtacccttcggtcggggtccctagtaccctccgtctttcgtcgtcggtccttaccgtaggtccgtacgggaccctaaaccgcccgggtcccttacccgtacgtaaaccctacgttcccgttcggtcggggtaccctcccggtagggtccgtagggaacgggaacggtaggtcttaggtactttattacgtcgtcgttagctactatagtcgagtagtacgtaggtactaacgtccgttaccggtaggtttaccggacggggtaccgggtaacgggaaccgttaacggggtccgtacccgtaccggttacggaccgaccggtacccgtaacggtccccg

SEQ ID NO: 317152 - DNA, 550 bp, Homo sapiens
  misc_feature: GZ8MTXP02ILIGR.9.21.B10.1.454.CMB.2.raw
  modified_base (287)..(287): a, c, t, g, unknown or other
  misc_feature (287)..(287): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggctattataaccttgtctctgtatcaacaacgccagacaaagccccanactcttaattatgagtcactaagcggcctgagggtttctggtcgtcttcctctgcctacaagttcctggccaacacggccctcccngacaatcnctggctcagtctgacgacgagctgattatactgcagctcatatgctagttcggttccttacgtttacaaagtattacgttacggggcggtaacggtaaccgaacggtcgtacgtaaccggttcctggtaacgtccgaacggaccctaacgggtcctcggttaccccccg

SEQ ID NO: 317153 - DNA, 518 bp, Homo sapiens
  misc_feature: GZ8MTXP02GRHJ0.9.21.B10.1.454.CMB.2.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggctattataccttgtctctgtatcaacacgccagacaaacgccccacactcttaattangagtcactaagccgccctgtagggtttcngtcgcttctcctgcctcaagtctggcacgcgccctcctgacaatctcnggcctcgatctgacgtacgagctagattatacgtgcagctnatatgctagttcgttcttnttcaaagtntagtcgggacgggtacgcgacgcgtcggtaccgtcgtacgaacgtacgaccgaccgtacgtccgtcccgtcccgtaccg

SEQ ID NO: 317154 - DNA, 528 bp, Homo sapiens
  misc_feature: GZ8MTXP02HIOTF.9.21.B10.1.454.CMB.2.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccacactgatattgggcattataaccttgtctcctggtatcaacaacgcccagacaaagcccccanactcttaatttangagtcactaagcggaccctgagggtttctggtcgcttcctctgcctccaagtcctgcaacncgcctccctgacaatctctggctccgagtctcgacgacgaggctgattattactgccagtcncatangcagttgtccttcttcaagtattacgttcggacgggacggaccaggccgtcgtaccgtcctaaggcgtacacgaccctaagggccttcgccccccg

SEQ ID NO: 317155 - DNA, 575 bp, Homo sapiens
  misc_feature: GZ8MTXP02F9SE9.9.21.B10.1.454.CMB.2.raw
  modified_base (287)..(287): a, c, t, g, unknown or other
  misc_feature (287)..(287): n is a, c, g, or t
tcagtgatacgtctcacgaccggtgctcgatttagtgtcgtcgcaagagaggagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctctgtatcaacacgccagacaacgccccanactcttaattatgagtcactaagcgccctcgtaggggtttctggtcgtcttcctctcgcctcagtctggccaacgaccggtcctcctgacaactctcgtcgggtcctaaaaaaccgcgtacgtcgacgacggacggactagtattattactcgacagactctatatcgtcgtagttcggttccttctttacgtaagtaacgtacgttcgggtacgggtacgggtaccgacggtcgtacgtaccgtccgtaacgtacgtacgtacgaccgaacggccgtccgtcccccg

SEQ ID NO: 317156 - DNA, 557 bp, Homo sapiens
  misc_feature: GZ8MTXP02ILY04.9.21.B10.1.454.CMB.2.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccacactgatatgggcattataacttgtctctgtatcaacacgccagacaacgcccccacactcttaatttagtgggtcacgtaagccgccctcgtagggttctggtcgtcttctcctgcctcaagtctgcacgccgcctccctgacctaatctcgtggctccgagtctaggaacgtacgacggtctgtaactttatacgtcgactagtccttcattagtgtcgtagtttcgttccttcttcaaagtcttaagttcgggacgggaggaccgtaggctcgaccgttctaggtaacgtcgaacgcccgaaggtcctacccggccccgttacgg

SEQ ID NO: 317157 - DNA, 544 bp, Homo sapiens
  misc_feature: GZ8MTXP02IMVWO.9.21.B10.1.454.CMB.2.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatattgggctattataaccttgtctcctggtatcaacaacgccagacaaacgccccacactcttaattatgagtcactaagcgccctgagggtttctggtcgtcttcctctcgcctccaattcgcgcaacacggcctcctgacaatctacgtggcctcagtctgacgacgagctagattatactgacagtctacatatgctagtttcggttcctactttacaaagacttaagttcggacggtacgggaccaggtccgtacgtacccgtccgtgtacgaccgacgacccgaacggcctttccggccccccg

SEQ ID NO: 317158 - DNA, 595 bp, Homo sapiens
  misc_feature: GZ8MTXP02GRM5E.9.21.B10.1.454.CMB.2.raw
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatagttggctattataaccttgtctcctgtatcaacaacgccagacaacgccccanactcttaattangagtcactacgcgccctcgtagggtttctggtcgtcttcctctcgcctacaagtctggcaacgacgtcctcctgaactatctcgtcggctccgagtctagacgacgaggctacgtaatttacttaactgactacgtctactatagtcgtacgtacggtttcggttccctttctttaccgaaaagtacttacggttcggggacgggtaacgggtaccgtaacggccgtacggtaacccgtccgtaagtacggtaccaaccggacccgtaaacggcccgtacccggtccccccgg

SEQ ID NO: 317159 - DNA, 559 bp, Homo sapiens
  misc_feature: GZ8MTXP02IFR7S.9.21.B10.1.454.CMB.2.raw
tcagtgatacgtctcacgaccggtgctcgatttagtgtcgtcgcaagagaggaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagtggctattataacttgtctcctgtatcaacaacgccagacaaacgccccaacactacttaattatgagtacaactaagcggcctcgtagggttctggtcgtcttcctctcgcctcgaagtctgccaactaccggccctccctagacaaattcctacgtcgggcctaccagttccacgtacgacggaggcttagattaattactgactagctactatatgactagttcgtttcctatttcaagtacttacgtcgggtaggacggtaccacggtctcgtacccgtcgtgacgtacacgaccgacggtccgtaccgtcccccg

SEQ ID NO: 317160 - DNA, 575 bp, Homo sapiens
  misc_feature: GZ8MTXP02HW2P0.9.21.B10.1.454.CMB.2.raw
  modified_base (298)..(298): a, c, t, g, unknown or other
  misc_feature (298)..(298): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactgatagttggctattataaccttgtctcctgtactacaacacgccagacaaacgccccacactacttaattngacggtacaacgtaacgccgtccctacgtagggttctggtcgtcttctcctcgcctacagtctcggacacgaccgcctccctagacctaatctcgtcgcctcgacgtcgacggacgacgtacggctagtattacttacgtgaccagtactnatagtgtacgtaggtttcgttacccttnttacaagtattacggtcggacggggacggacgacggcgtacgacccgtcgtagtaacgtacgaccggaccgaacggcctcccggtacccccgttccgg

SEQ ID NO: 317161 - DNA, 555 bp, Homo sapiens
  misc_feature: GZ8MTXP02IJYH4.9.21.B10.1.454.CMB.2.raw
  modified_base (423)..(423): a, c, t, g, unknown or other
  misc_feature (423)..(423): n is a, c, g, or t
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactggacccacactgattagttgggactattaataacttgtctctgtatcaacaacgccagaacaaccgccccacactactttaattatgagtacacgtaagccgtcctcgtaggggtttctcggtctcttctactcgtcctactaacgtctacggccaaacgaccggtaccctccctagtacaattcctcgtcggcctcagtntacgacgacgtaggctagtatacttactgccatctntatatgactagttcgttcctntttacaagtatacgttcggaggtcggaccgagcgtacgtccgtactgacgtacgacgacgacggctccgtccccg

SEQ ID NO: 317162 - DNA, 548 bp, Homo sapiens
  misc_feature: GZ8MTXP02I4HFO.9.21.B10.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (407)..(407): a, c, t, g, unknown or other
  misc_feature (407)..(407): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (512)..(512): a, c, t, g, unknown or other
  misc_feature (512)..(512): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactgatagtggctattatactgtctctgtatcaacacgccagacaacnccccanactacttaattatgagtcacgtaacgccgcctgtagggttctggtcgtcttcctctcgcctccaagttcgtcgccaacgaccggccctccctagactaactctcgtcggacctcgacgttcngacgacgacggctagtattattacagcagtctacatatcgtctagtttcgttccttnttacaagtnttacgtcgggacggacggtacgaggtcgtacgccgtcgngacgtccacgtaccgacggtccgtaccgtcccccgg

SEQ ID NO: 317163 - DNA, 618 bp, Homo sapiens
  misc_feature: GZ8MTXP02HPEDZ.9.21.B10.1.454.CMB.2.raw
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactcgacccacactgatagtggctattactaacttgtctctgtactcaacacgccagaaccaacgccccacacttacttaattatgagtacaacgtagccgccctgtagggtttcnggtctcttctcctcgcctacagtcncgcacgcgcctccngactactctcgtaggcctaccgtgtacgtacggaaccggtacggacgtcgttacgttaatttacttacgtcggtacctacggtcttactagttacgttacgtacgtttacggttttcggttaccctttacgtttaccgaaagttacgttacggttcgggacgggtacggtaccgtacggtaccgtcggacccgttaccgagtaaccgtacgaccgtacccgacgtcccgtacccgtaccccgtttacccgg

SEQ ID NO: 317164 - DNA, 559 bp, Homo sapiens
  misc_feature: GZ8MTXP02GDXZX.9.21.B10.1.454.CMB.2.raw
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgcccagacaaacgccccacactacttaatttatgtagtacacgtaagcggccctcgtaggggtttctggtcgtcttcctctcgcctcaagtctcgcaacacggcctccngacatctcgtgctcagtctgaccgagacggtntatattactangactagtctatatancgtacgtagtttcgttacctacttaacgaagtagttacggtacgggacggacggaccgtacggtcgtacgtaccgtcgtaagtacgtacgacgacccgtacggtcccgtaccgtccccg

SEQ ID NO: 317165 - DNA, 668 bp, Homo sapiens
  misc_feature: GZ8MTXP02F6UKM.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaacctcctcactcaggacacagggtcctgggccctgtctgccctgactcagcctgcctccgtgtctgggtctcctggacagtcgatcaccatctcctgcactcggacccaccactgatattggctattataacttgtctctgtatcaacacgccagacaaacgccccacactacttaattatgagtcactaacgccgccctcgtagggtttctggtcgtcttaccctctacgcctacctaaagtcgtcggaccaaccgaccggtcccttaccccgtacgaacctaaacttccttaccgtcgggtccctccgaacgttcctaacggaaccgacccggaagggtccttaggtaaactttacgttaactcggtacacgtctactaataactcgtaccgtaggtttcggtttaccttacttaacgtaagtagttaacggtttccggggacggggtaaccgggaaccgtaacgggtcccgttacggaaccccgtttcgtaacggaacgttccgaaccggacccgtaaacgggtccctacccgttcccccccgg

SEQ ID NO: 317166 - DNA, 600 bp, Homo sapiens
  misc_feature: GZ8MTXP02IGVNE.9.21.B10.1.454.CMB.2.raw
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (473)..(473): a, c, t, g, unknown or other
  misc_feature (473)..(473): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcacccctcctcactcaggacacagggtcctgggccctgtctgccctgactcagcctgcctcgtgtctgggtctcctgcacagtcgatcaccatctcctgcactcggacccaccactgtatagttgggctattataaccttgtactcctggtatacaacaccacccagaccaaacgccccacacttacttaattatagagtacactaagccggtcctcgtacgggttctggtcgtctttctctcgcctacgaatcgtcggacaacncggtcccctccacgaactactctcgnggtcctcgtacgtctcggacgacggacgtactagatttaaacttactcgtacagtcccttaanatacgtgtacgtttcgtttcgttaccttagttacaacggttacgttacggtccgggacgggaacggaccgtacgtccgtccgtaccgtcgtacggacgtacgaaccgaccgtacggtcccgtcccgg

SEQ ID NO: 317167 - DNA, 682 bp, Homo sapiens
  misc_feature: GZ8MTXP02GG85V.9.21.B10.1.454.CMB.2.raw
  modified_base (326)..(326): a, c, t, g, unknown or other
  misc_feature (326)..(326): n is a, c, g, or t
  modified_base (533)..(533): a, c, t, g, unknown or other
  misc_feature (533)..(533): n is a, c, g, or t
  modified_base (576)..(576): a, c, t, g, unknown or other
  misc_feature (576)..(576): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgccctcgtgtcgtcggtctcgtgactagtcactaccactactcctccgtcgacctacgtaccgaccccacctagtagtaattaggtcggacttaattaacttaccttgtacctcgtagtactaccaaccgaccgaccaagaaccgaaccccnccccaacttaccttaacttttaaattacgtacggtacgtctaaacggtacggcccgtaccgttagggttacgggtttcgtcggtcctcttccgtaccgtcgtccctacgtacgtccgtcgaccaccgtaccggtcccttcgacaactacttccgacgttcgacctcgtaacgtcgaacgacggaggtctacgttataatttactcgngactacgtctatattgcgtacgtttcggtttcttaaccctttntaacgtagttacgttacgggtaccgggacggacgtacggcgttccgtaccgtccgttacgcgacgtacgacccggtaccgtaccggtccctaccccgggttccccg

SEQ ID NO: 317168 - DNA, 540 bp, Homo sapiens
  misc_feature: GZ8MTXP02IYHHN.9.21.B10.1.454.CMB.2.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
tcagtgatacgtctcacgaccggtgctcgatttagtgtcgtcgcaggaggaggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggctattataacttgtctcngtatcaacacgccagacaacgcccccanactctaattangagtcactaagcggaccctcgagggtttcnggtccgcttcgcctgcctcgaatctgacacncgccctcctgacctaatcctgcgggctaccacgtctacgacgacgacggctgaatttacgtactgcagcctnatactgactggttcgtcctntttcgaaagtntagttcggacgtagggaccctaggtctacggtacctccgtagtaagtccgaaacgcccgaaggtcccgtccgtaccccggttccg

SEQ ID NO: 317169 - DNA, 695 bp, Homo sapiens
  misc_feature: GZ8MTXP02H0FJ4.9.21.B10.1.454.CMB.2.raw
  modified_base (305)..(305): a, c, t, g, unknown or other
  misc_feature (305)..(305): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtcgtggtctcctggacagtcgatcaccatctcctgcactcggacccacactgatattggactattactaaccttgtctcctgtactacaacacgcccagaacaaacgccccatactaccttaatttangacgtacactaagccgccctacgtagggttctggtcgtcttctcctcgtcctcaagttctacggactacaccggtaccctcccgtacgaacctaactccgttaccgtcgggtccctaccgtacgtccgtacggaaccggtacggacggtcgttaacgttaacgtttacgtttaaacgcgggtacctaacggtccttaacgtaacttaacggtcgtacgttaacgggtttcggtttaccctttctttaaccgaagttaacgttacggttccggggaacgggtaccgggtaacctacggggccttaccgggacccggtttaccgtacggtaaccggttaccgaaccggtccccgtaaacgtcccccggttcccggttaaccccccgttccgg

SEQ ID NO: 317170 - DNA, 597 bp, Homo sapiens
  misc_feature: GZ8MTXP02HGZ1I.9.21.B10.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (296)..(297): a, c, t, g, unknown or other
  misc_feature (296)..(297): n is a, c, g, or t
  modified_base (347)..(347): a, c, t, g, unknown or other
  misc_feature (347)..(347): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacctactctcctgcacgtcgacccacatgatgtggctattactactgtctctgtatcaacacgccagacaacncccanactnttaattnnagtcactagccgcctgtaggttctggtctctcctcgcgtcctacgagtcncgcaaacgcgtcctcctagacacttctcgtcggccctacgacgtcgtacgacgacggaacggtctaagttacttaacttaccgtggactcgtacctatactagtcgtcggtttacgttcgtttaccttacgtttaacgtaagttacgttaacggtcgggtaccggggtaacggtaccgaacggtcgtaccggtaaccggttcgtaaggtcgaccggtaccggacccaacggtcccgtacccggtcccccg

SEQ ID NO: 317171 - DNA, 666 bp, Homo sapiens
  misc_feature: GZ8MTXP02H2RZD.9.21.B10.1.454.CMB.2.raw
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggaccccaccactgatattgggacatttactaaccttgtctctgtatcaacaccgccaanacaaacnccccacactctaattngagtcatacgccgcctgtagggttctgtctctctcnctcctacagtctcggactaccgccggccctcctagaaccaactcgtcgtacgggcctccgtacgtcacggtaacggacgagggtctagtaactttactacgtggtaccaaggtcctctaagttcgtaggtccgtttaaggtttccgtttaccctttattttaccggtaaaagtacgttttaccgggtttaccggggaccgggggtaacgggtaaacccgtcggggttacgtttacccggaaccccggtttcccgtaggttaaaccggcccgttaaaaccggcccccgtaaagggtcccctttacccccggaacccccggttttccccggg

SEQ ID NO: 317172 - DNA, 632 bp, Homo sapiens
  misc_feature: GZ8MTXP02HSUL7.9.21.B10.1.454.CMB.2.raw
  modified_base (243)..(243): a, c, t, g, unknown or other
  misc_feature (243)..(243): n is a, c, g, or t
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (461)..(461): a, c, t, g, unknown or other
  misc_feature (461)..(461): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtggactagtcgactcaccatctcctgcactcggaaccccacactgatagtggntattaactacttgtctctgtactacaaacacgaccaagaccaaaccgccccactacttactttaaattnagagtacactacgccgccgtgtacgggttcnggtctcttcgtcctcgtcctacgatcgtcgacacgccgtacctccgtanaactactctcgtcgctcgtacgtcgtacgcgtaaaaaaacgcgtagtacgtattaactacttacgctanctactatattcgtcgttacggtttcgtttccttaccgtttaactaagttaaagttcgtacggggtacgggtacgggtaaccggaacggtccgtaccggtaccgtccggttacggtaacgtacggaaccggacccggttaacggacccgtcccggttacccggtttccccgg

SEQ ID NO: 317173 - DNA, 659 bp, Homo sapiens
  misc_feature: GZ8MTXP02JAKV5.9.21.B10.1.454.CMB.2.raw
  modified_base (345)..(345): a, c, t, g, unknown or other
  misc_feature (345)..(345): n is a, c, g, or t
  modified_base (453)..(453): a, c, t, g, unknown or other
  misc_feature (453)..(453): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctcgccctgactcagcctgcctccgtgtctggtctcctggacagtcgatcaccatctcctgcacgtcggacccaccactgtatagtggactattactaacttgtctctgatcaacacgccagacaacgccccactactacttaattatagacgtacaactaacgccggcccgtcgtagggttctggtctcttcnctcgcctctagtcgtacgacacgccgcctaccgtagaccaacttctccggtggtccctactacgttctacggaacccgaggacggttctaaggttacttaacgttacnggtaccaaggtcccttaacaattcgttacgaccgtttaggtttcccggtttcttacgttacctaaagttacgttaacggtttccgggggaacggtaccggaaacccggtgggtacccttaccgggacccggtttacgtaaccggttaaggacccgtaacggaccccgtaacgggttcccccgtcccgggttaccccctttaccggg

SEQ ID NO: 317174 - DNA, 702 bp, Homo sapiens
  misc_feature: GZ8MTXP02JJ159.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgtatattgggactattactaaccttgtctcctgtatcaacaacgccaagacaacgccccacactacttaatttatagaggtacaacgtaacgccgtaccctgtacgggtttctggtcgtctcccgtctacgtccctaccgtacgtcgttacggccgaaaccgtacccggtcccttccccgtaagtaccctaaaacgttcccgtacggttccggggtaacccttcccgtaaccgggttcctaacgggaaccggtacccggagggtaccttaggttaactttaacgtaccgttcgaccgacgtacctagagttaactcgtacgtacggtttcgtttacccttcgtttaacctaaggtagtttacggttaccggggacggtaccgggtaacccggtggtaccgtccggcccgttcgttaacgacggttacgacccggtaacctaccggggtccctacccggttcccccgg

SEQ ID NO: 317175 - DNA, 562 bp, Homo sapiens
  misc_feature: GZ8MTXP02G1L7G.9.21.B10.1.454.CMB.2.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (413)..(413): a, c, t, g, unknown or other
  misc_feature (413)..(413): n is a, c, g, or t
tcagtgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccaccactgatacgttggactattataacttgtctcctgtatcaacacgccaanacaaacnccccacactntaattangagacanacgcgcctgtaggttcngtcncttnctgccncatcngacacgccgcctccagactactctacgtcggcctccacgtcgtagcgaagcggcttagtaattactcgtacnctactctatattacgtagtacgttcggtttcgttcgttacttacgtaacgtacgttacgggtacgggacgggacggtaccgtacggtcctaccgtccgtacgtacgaacgtacgacccgtaccgtaccgtccgtacccgtcccgttccg

SEQ ID NO: 317176 - DNA, 713 bp, Homo sapiens
  misc_feature: GZ8MTXP02JEWYL.9.21.B10.1.454.CMB.2.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccacactnatattggctattataacttgtctcctgtatcaacacgccanacaacgccccactactcttaatttangacgtcactaacgccggtcctcgtagggtttctcggtcgtcttccctctcgtcctaccgaagttcctacgggccaaccgacccggtaccccttaccctacggtaaacctaacgttcccgttaccgtcggggtacccttcccgtaacggttcctacgggtaaaccgaccggtaacggggtcttaggtaaacgttttactttaaaccggtcggttaccgaacgtccgttacctaaatttacgtcggtaaccgttacggttttccggtttaacccttacctttttaacgaaaaggttaacgtttaacggtttaccggggaccggggtaccgggtaactacggggttcctacgggtaccccgttcgtaacggacgtaccgacggtacccgaacggtcccgtacccgtacccccgg

SEQ ID NO: 317177 - DNA, 681 bp, Homo sapiens
  misc_feature: GZ8MTXP02FPC97.9.21.B10.1.454.CMB.2.raw
  modified_base (343)..(343): a, c, t, g, unknown or other
  misc_feature (343)..(343): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatccaccatctcctgcacgtcggacccaccactgatagttggctattataaccttgtactcctggtatcaacaccgccagacaaacgcccccatactacttaattatgagtacaactaacgccgtcctcgtagggtttcnggtcgtcttacctctcgtacctaccgaacgtcgtacgaccaaccgtacccgggtccccttaccccgtagtaaaccctaaacgttccgttccggtacgggtaccctccgtaacgtctacgaacgacggacggtctaagtacttacttacgcgtactacgtctactagtaatccggtagttacggtttcggtttcccttagtttaaacgagttacgttacggttacggggcggaaacgggtacctaacgggtccgttaacggtccccgtttacgaacggttcccgttaccggaaaacccggcccggtaaaacccggtcccgttaaccccggtccccccgg

SEQ ID NO: 317178 - DNA, 581 bp, Homo sapiens
  misc_feature: GZ8MTXP02G3OL4.9.21.B10.1.454.CMB.2.raw
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatccacatctcctgcacgtcgacccacactgatagtggctattactaaccttgtctctgtactacaacaacgccacgaacaaccgaccccacacttacttaattatgtaagtaactacgcgtccctcgtagggtttcncggtctcgttctcctctcctcaagtctacggacaccgaccgtcctccagactactctcgtcggacctccgagtcgcggaacgacggtacggtctagtaacttacgttacngactacgtcctataacttgtacgtacgttaggtttccgttacttcttacaagtacgttacgtcgggacggtacggaccgcgtacgcgtaccgtcgagaacgtcgacgaccgagtccgtccgtcccgtcg

SEQ ID NO: 317179 - DNA, 623 bp, Homo sapiens
  misc_feature: GZ8MTXP02GAGXG.9.21.B10.1.454.CMB.2.raw
  modified_base (249)..(249): a, c, t, g, unknown or other
  misc_feature (249)..(249): n is a, c, g, or t
  modified_base (317)..(317): a, c, t, g, unknown or other
  misc_feature (317)..(317): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (499)..(499): a, c, t, g, unknown or other
  misc_feature (499)..(499): n is a, c, g, or t
tcagtgatacgtctcacgaccggtgctcgatttagtgtcgtcgcaagagaggaggggggggggtcacaagaggcagcgctctcgggacgtctccaccatggcctgggctctgctgctcctccaccctcctcactcaggacacagggtcctgggccctgtctgccctgactcagcctgcctcgtgtctgggtctccgtggacagtcgatccaccatcctcctgcactcggaccccacactgatagtcggntattataaccttgtctctggtactacaacaaccgccaagaaccaaacgcccccacactcttaatttangagtacactaacgccgcctacggtagggtttctggtcgtcttcctctctcctctaagtcctgcaccaccggtccctccgagtacatctcgnggtcctcngtctggacgacggacgtactgtaattacttacgtacgcgtagtactctaagttactcggtgtaacggtttcggttaccccttntttaacgaaaacgttgttaacggtaccgggggtaggtaaccgggggaaacctcgggtaccgtcggtaacccggttcgtaagtcggtacgaccgtacccggacggtcctccccgggttacccccg

SEQ ID NO: 317180 - DNA, 666 bp, Homo sapiens
  misc_feature: GZ8MTXP02IO4H3.9.21.B10.1.454.CMB.2.raw
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgccctccgtgtctgggtctcctggacagtcgatcacatcctcctgcactcggacccacactgatagtggctattactactgtctctgtatacaacaacgccaagacaaccgcccccactactactttaatttatagacgtacaacgtaacgcccggtcctacgtacggggtttctggttcgtcctttccgtcctcgtaccctaccgtaacgttccgttacggaccgtaaaccgacccggtccccttacccgtacgaactaacttccgtcgtcggacctccgagtcgtacgacgacggacgtcgtagtattcgttaacgtgtcacgtctactatacgtgtacgttagtttcgttccttcgtttaacgtaacgttagttacggtacggggtaccgggtaacgggtaccgtaaacggtccgtaaccgtacccggttccgtaacggtcgtaaccgttaccggaacccggaaccggtccgttaccccggtcccccgg

SEQ ID NO: 317181 - DNA, 663 bp, Homo sapiens
  misc_feature: GZ8MTXP02F6PFK.9.21.B10.1.454.CMB.2.raw
  modified_base (294)..(294): a, c, t, g, unknown or other
  misc_feature (294)..(294): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcgatcaccatctcctgccactacggaccccaccactgattagtgggactattactaaccttgtctcgtgtatacaacaccgccagacaaccnccccatactacttaattatgagtacaacgtaagcccgtccgtacgggttcgggtttcgtcgtccgttcttcccgttactcgtccctacgtacgtcggtcgacccgtaacgtcccgggtccctacccgtagaaccttactccgttcggtcggtccctacgtagttccgagaacccgaggtacgtacgttattaactttacttaggccacgtacgtctaactgttacgtgttactttacgggtttctttaccttagttaacgagtttaaacggttcgggttaccggggacgggtacggacgttacggacgttacccgtcggttacggcgtacggtaccgaccgtaccgacggccccgttaccggtcccccg

SEQ ID NO: 317182 - DNA, 610 bp, Homo sapiens
  misc_feature: GZ8MTXP02I779J.9.21.B10.1.454.CMB.2.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcgatcacatcctcctgcactcgacccacactgatagtggactattaactaacctntctctgtatacaacacgccagacaaccgccccanactactttaattatagacgtacaacgtaacgcccggtcctagtacggggtttctcggtcgtccttcctctccgcctacctagtctacgcaacgaccgccctccagacatcgtcgcggcctcgacgtctcggacgaacggtcggtntagtactttacgttaccncgtacacgtactatatacgtcgtcgttacgtttcgttacttcgttaagtaacgtacgttacggtacgggacgggtaacggaaccgtcggtacctaccggtccgtacgtaacgtaccgtaaccgacgtaacccggaccgtccccgtacccgtccccg

SEQ ID NO: 317183 - DNA, 634 bp, Homo sapiens
  misc_feature: GZ8MTXP02GPXS2.9.21.B10.1.454.CMB.2.raw
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagtgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcgacccacactnatgtggctatataacttgtctctgtatacaacacgcccanacaacgccccactactcttaattatagagtactactaacgccgtaccctgtacgggtttctggtctcttacctctgcctacctagtctcggacaccgccgtaccctccgtacgaactactccgtacgtcggtaccctcgtacgtcctagggaccgtacggtacgtccgtaaagtactttacgttacaggtaccagtctacgtaacttgtcgtacgtttcgtttcggttacctttgttaacaaagttaggttacgttaccggggacggggtaaacgggtcccacggtaccggttacgtaacccggtcgttggaaaccggttcaaccgggtacccgaacggtccccgttacccgtcccccgg

SEQ ID NO: 317184 - DNA, 792 bp, Homo sapiens
  misc_feature: GZ8MTXP01BX9IC.44.19.B08.1.454.CMB.2.raw
tcagacagtatatacacgaccggtgctcgatttagtgagtcagtaaggggcaggagtcagtcccaaccaggacacagcatggacatgagggtccctgctcagctcctggggctcctgctgctctggctctcaggtgccagatgtgacatccagatgacccagtcctccaccctccctgtctgcatccattggagacagagtcaccatcacttgccaggcgagtcagggcatcaactaagtattaaatgtatcagacaacaaaccaggacacgacccctaaactcctgactaccgaaggacctccgtaccctaaagttttacgggaaaacgtacgggggtccccgtacgtaaacgggtttccccaaggacgggtaaaggttcggggttacgttaacgggggtaaacctttcgggttttttacctccctttccgttacccggttacctaacttaacccaaaaaccctaaacccgttaacaaccggtacccttaggaaaacgtagttaccgggttagggaaccctaaaacctaaattaactttaaaccttacggttacccaaacccgtaaggttaacttagggaaccctaaagggtttcccgttaaccccctttaaaccgttaaccccggttttacgggaaccccggtaaacggggggttaacccccaaaagggttaaaggaaacggttaaacttaaacccgaaaaaccgttaaaccgtgggttacgggaccttacggtaacccaaccctaatttcccggtttacgtttacctttaaccgttaaccgtttccccg

SEQ ID NO: 317185 - DNA, 559 bp, Homo sapiens
  misc_feature: GZ8MTXP01DR75E.44.19.B08.1.454.CMB.2.raw
  modified_base (178)..(178): a, c, t, g, unknown or other
  misc_feature (178)..(178): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctnacgctgacctgcatcgtctcaggcttctcactcgtcactcctggagagggcttgtcgtgggtgcggcacggcccccggaaaggccctggagtggatcgcactcacttattggaatgacgatatacgatatagtccttctctgacgacagactcacgcctcacgaagacacgtaaaccaaaaccnggtcgtaccttacattacgacctaacgtcggaccctgtaggacacgaggacaactatttattctgtcgccctattcatcgaaccaanaactcgaccgacgggtcttaccgttcgaacccgtggggccagggaactccgaggtcaccgtctcacttcacgcctaccaaccgaacggcccagtccggttcccttccccg

SEQ ID NO: 317186 - DNA, 571 bp, Homo sapiens
  misc_feature: GZ8MTXP01A3JBI.44.19.B08.1.454.CMB.2.raw
  modified_base (360)..(360): a, c, t, g, unknown or other
  misc_feature (360)..(360): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttatggaatgacgatatacgatatagtcttctctgacgacagactcacgctccacgagacacgtaccaaaaaaaccnggtgtcctacattcgaccaacgtcgaccctgtggacacaggcactattatttctgttcgcccctaactttcacttcggacccaactaatcgacctacgggcttcgttaccgaacccgttgggggacccaggggaactccgagggttccaccgttctcacttcgacgccctccaccgtaacgggcccctagttcccggtccttccccgccgg

SEQ ID NO: 317187 - DNA, 572 bp, Homo sapiens
  misc_feature: GZ8MTXP01EQ7U2.44.19.B08.1.454.CMB.2.raw
  modified_base (276)..(276): a, c, t, g, unknown or other
  misc_feature (276)..(276): n is a, c, g, or t
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (520)..(520): a, c, t, g, unknown or other
  misc_feature (520)..(520): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctggggtgcggcacggccccccggaaaggccctggagtggancgcactcacttattggaatgacgatatacgatatagtccttctctgacgaccagactcacgctccacgaagacaacgtacccaaaaaaaaccnggtcgtaccttaacgattacgaaccaacgtcggacccctgtacggacacgaggacactattatttcngtcnccctattcatcggaacacaatcgaccacggtcttcgtaccgaacccgtggggaccagggaactccgaagttccaccgttntcacttcgcgccctcaccgaacgggcccctagttccggtccttcccccgtgg

SEQ ID NO: 317188 - DNA, 620 bp, Homo sapiens
  misc_feature: GZ8MTXP01B5KZS.44.19.B08.1.454.CMB.2.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggtcgttgtcgtgggtgcggcacggcccccggaaggcccgtggagtggatcgcactctacttagtggaatgacgatatacgatatacgtccttctctgacacagactcacgctcacgagacacgacaaaaacngtcgtctanatcgaccacgtcgacctgtgacacgagcatattacttcngtcnccctacttacactacggaaccaactaacgtccgaaccgtacgggtcctttaccgtaaccgaacccggtcggggaccctaaggggaacctcccggacggttcccgtaacccggttctaccgtacttaccgaccggttcccctaacccgaacccggtaaaccggggtccccctacggttccccggggttccccctttcccccggtcccggg

SEQ ID NO: 317189 - DNA, 588 bp, Homo sapiens
  misc_feature: GZ8MTXP01DD2R0.44.19.B08.1.454.CMB.2.raw
  modified_base (197)..(197): a, c, t, g, unknown or other
  misc_feature (197)..(197): n is a, c, g, or t
  modified_base (562)..(562): a, c, t, g, unknown or other
  misc_feature (562)..(562): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctccacccctcctgtctgcatccagttgganacagagtccaccatctacttgccgagggcgagtcgagggcatcaataagttaattaatgtatcagacaacaaacgaggacacgacccctaaactcctgactccgagacctcgtacctaagttacggaaacgtcggggtaccctagtaacggttccgaggtacggtaaggtcgggtcgtagggacttgtttcctctcgtcgtacactacaaacctacctacgacgtaccgtagaagtagtgtacgactaaacattacttactgtaccaacgtagtaatgactgttcctcccttacgtccgttcggaccgtacgggaaccctaaggtaagagaactaccgaaacgtacgtgttacgcttcgccactntcttacgttcctcgttaacgttcccc

SEQ ID NO: 317190 - DNA, 539 bp, Homo sapiens
  misc_feature: GZ8MTXP01BLNGV.44.19.B08.1.454.CMB.2.raw
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagacagtatatacacgaccggtgctcgatttagtgagtcagtaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttctctgacgaccagactcacgctccacgaaggacacgtaccaaaaaaacnggtgtctacattgaccacgtgaccctgtggacacaggcacatatttcngtcgcccattcatggaccanaatgaccncgggcttcttccgaaccctggggccaggggactccgaggttccaccgttctcacttcacgcctccaccgaagggcccagttccggtccttccccgtcggg

SEQ ID NO: 317191 - DNA, 521 bp, Homo sapiens
  misc_feature: GZ8MTXP01DMHWN.44.19.B08.1.454.CMB.2.raw
  modified_base (482)..(482): a, c, t, g, unknown or other
  misc_feature (482)..(482): n is a, c, g, or t
  modified_base (502)..(502): a, c, t, g, unknown or other
  misc_feature (502)..(502): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcactattggaatgacgatatacgatatagtccttctctgacgaccagactcacgctcacgaggacacgtcaaaaaaacagtgctacattgaccaacgtgaccctgtcgacacaggcacatatttctgtgcccattcatggaccacaatgaccacggcttctcgaaccctggggcccagggaatccaggttcaccgctcattcngccctcaccaacgggcccanccggtcttcccccgtcggg

SEQ ID NO: 317192 - DNA, 741 bp, Homo sapiens
  misc_feature: GZ8MTXP01D0M3F.44.19.B08.1.454.CMB.2.raw
  modified_base (719)..(719): a, c, t, g, unknown or other
  misc_feature (719)..(719): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattggagacagagtcaccatcacttgccaggcgagtcgagggcatcaacttaagttaatttaaagtggtatcagacaacaaaccgaggaccacgacccctaaactcctagactaccgaggaccttcgtaccctaaagttttacgggaaaccgtacgggggtaccccgtacgtaacgggtttcccgaggtacggggaaaggttcggggtacgttaacgggggtaactttaacgggtttttccttaccgttccgttaccgttacctaacttaaccctaaaaccctaaaacccttaacgaacggtacccttaagggaaacgttagttacgggttacggaaacctaaacgtattaaacgtttaccttagtaaccccaaccggtaaagtttacgtacggtaacctacgttcccgttaccccctttacgtaacccggttttgggaaccccgtaaacgggggtaacccaaacgggttaagaacggaaattacccgaaaacgtacgtggttacggcttacgaacctacctaattccgtnttaccttcgttaactttccccg

SEQ ID NO: 317193 - DNA, 689 bp, Homo sapiens
  misc_feature: GZ8MTXP01DGKW9.44.19.B08.1.454.CMB.2.raw
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcaccggccccccggaaaggccctggagtggatcgcactcacttatggaatgacgatatacgatatagtcttctctgacgacagactcacgctccacgaaggacacgtaccaaaaaaccnggtgtacctacattacgacccaacgtcgaccctgtacggacacgaggcactattatttctagtcncccctactttcaacttcggaaccctaactaaacgttccggaacccgtaaaccgggggtcccttttaccggttaaccccggtaaacccccggttcggggggacccctaaacggggggtaaactccccggtaaacggggtttcccaaacccgggttccttaccaacgttacccgaccggttacccctaacccccgaaacccggaaacccgggggtccccctaacggttccccggggttccccttttccccccccggtccgggg

SEQ ID NO: 317194 - DNA, 572 bp, Homo sapiens
  misc_feature: GZ8MTXP01CCXIZ.44.19.B08.1.454.CMB.2.raw
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcacggccccccggaaaggccctggagtggatcgcactcacttatggaatgacgatatacgatatagtcttctctgacgaccagactcacgctccacgaggacacgtaccaaaaaaacngtgctanattgaccaacgtcgaccctgtggacacaggcacatatttctgtcgcccattcattggaccacaatcgaccacgggtcttcgttaccgaacccgtggggaccaacggggaactcccgaacgggttcctaacccggttctaccnttacccgngaccccgtccaaccgaacgggccccagttcccggtccctttccccgtcccgg

SEQ ID NO: 317195 - DNA, 557 bp, Homo sapiens
  misc_feature: GZ8MTXP01B70XO.44.19.B08.1.454.CMB.2.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (507)..(507): a, c, t, g, unknown or other
  misc_feature (507)..(507): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctggggtgcggcacgccccccggaaggccctggagtggancgcactcacttattggaatgacgatatacgatatagtccttctctgacgaccagacctcacgctccacgaaggaccacgtaccaaaaaaaccnggtcgtcctacattcgaccaacgtgaccctgtaggacacaggcacgattatttcngtcgcccattcatggaccanatcgaccacggtcttcgttaccgaacccgtggggaccagggaactccgaggttccaccgttctcnttcgacgccctccaccgaacgggccccattcccggtccttccccgtcggg

SEQ ID NO: 317196 - DNA, 548 bp, Homo sapiens
  misc_feature: GZ8MTXP01DTBKM.44.19.B08.1.454.CMB.2.raw
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaaacccacacagaccctcacgctgacctgcaccgtctcaggcttcncactcgtcactcctggagagggcgttgtcgtgggtgcggcacggccccccggaaaggccctggagtggatcgcactcacttatggaatgacgatatacgatatagtccttctctgacgacagactcacgctaccacgaagacacgtacaaaaaaacngtgtctanatnacacgngaccctgacganacagcacatattcngtcgcctatnatcgacanaatcgaccncggtcttcgttaccgaaccgtgggcccaagggactccgaggttccaccgttctcacttccgacgcccctccaacccgaacgggccctacgttcccgggtccttccccgtcccgg

SEQ ID NO: 317197 - DNA, 661 bp, Homo sapiens
  misc_feature: GZ8MTXP01EDVTA.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcgagggcatcaacttaagtaatttaaatggtatcagacaacaaaccgaggacacgacccctaaactcctagactccgaagtacctcgtaccctaaagtttacggaaacgtcggggtacccgtagaacggttaccgaggtacggaaggtgggtcgtaaggggtacttaaggttttcctcttccgttcgtactacgtacctaaacctaacctacgacgtaccgtaggaaagtagttacggtacggtaactaacgtaattaacttacgttacgtacctaaccgtaagttacgtacgtacgtacgttccgttaccccttacgtaccgtttacggaccgtaacggggaacctaacggtaagaacggttaaactaacgttaaaacgtacgtacggttgttccgttacgcaacctcttcgttcgttccttcgttcgttaaccccg

SEQ ID NO: 317198 - DNA, 542 bp, Homo sapiens
  misc_feature: GZ8MTXP01CCC9Y.44.19.B08.1.454.CMB.2.raw
  modified_base (363)..(363): a, c, t, g, unknown or other
  misc_feature (363)..(363): n is a, c, g, or t
  modified_base (446)..(446): a, c, t, g, unknown or other
  misc_feature (446)..(446): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggcccctggagtggatcgcactcacttatggaatgacgatatacgatatagtccttctctgacgaccagactcacgctccacgaggacacgtccaaaaaaaccnggtgtcctacattgaccaacgtcgaccctgtcgacacaggcacattattctgtgccctacttcatcggacctacaactgaccncgggcttcgttcgaaccctggggccagggactccgagttcaccgttctcnttcncgcctcccaccgaacgggcccacgttccgtccttcccgtcgg

SEQ ID NO: 317199 - DNA, 564 bp, Homo sapiens
  misc_feature: GZ8MTXP01EE5MZ.44.19.B08.1.454.CMB.2.raw
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
  modified_base (370)..(370): a, c, t, g, unknown or other
  misc_feature (370)..(370): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagacccctnacgctgacctgcaccgtctcaggcttctcactcgtcactcctggagagggcgttgtcgtgggtgcggccacggccccccggaaaggccctggagtggancgcactcacttatggaatgacgatatacgatatagtcttctctgacgaccagactcacgctccgacgaaggacacgtacccaaaaaaaaccngggtgtaccttacattcgaccacgtcgaccctgtaggacacgaggcactattatttctgtcgtcccattcatcggaaccacatcgaccacggtcttcgtacgaccgtgggccagggacncgtaggttcctaccgttctacncttcgcgcctcccaccgaacgggccccagttcccggtcccttccccgtccggg

SEQ ID NO: 317200 - DNA, 592 bp, Homo sapiens
  misc_feature: GZ8MTXP01BP6XR.44.19.B08.1.454.CMB.2.raw
  modified_base (206)..(206): a, c, t, g, unknown or other
  misc_feature (206)..(206): n is a, c, g, or t
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggcgttgtcgtgggtgcggcacggcccccggaaaggccctggagtggancgcactcacttatggaatgacgatatacgatatagtcttctctgacgacagactcacgctccacgaagacaacgtaccaaaaaaaccnggtcggtacttacattcgaaccaacgtcgaccctgtacggacacaggacanattaactttctcgtcgccccattcatcggaaccacaatcgaccgaccgggtctttaccgttaccgaacccgttcggggaccaggggaactccgagttccgaccgttcgtaccattccgcggcccctaacccgaaccgaaccgggccccacgttcccgggttcccttcccccgtccggg

SEQ ID NO: 317201 - DNA, 596 bp, Homo sapiens
  misc_feature: GZ8MTXP01CDV4H.44.19.B08.1.454.CMB.2.raw
  modified_base (437)..(437): a, c, t, g, unknown or other
  misc_feature (437)..(437): n is a, c, g, or t
  modified_base (531)..(531): a, c, t, g, unknown or other
  misc_feature (531)..(531): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaaacccacacagaccctcacgctgacctgcaccgtctcaggcttctcactcgtcactcctggagagggtcttgtcgtgggtcgcggcaccggacccccccggaaaggccccgtgggagtggactcgcactctacttagtggaatgacgatatacgatatagtccttctctagacgacagactcacgcaccacgaagacaacgtaaccaaaaaacctagtcgtacttaacattacgaccaacgtcgaccctgtagacacgagacactattactttcngtccacctattcaattcggaacaactaactcgaccgacggtccttacgttaccgaccgtgggaccagggaactccgagttcaccgttctaccgnttccgcgacccctaaccgaacccgtaacgggtcccctacgttcccggtcccctttccccggtcgg

SEQ ID NO: 317202 - DNA, 702 bp, Homo sapiens
  misc_feature: GZ8MTXP01AODAY.44.19.B08.1.454.CMB.2.raw
  modified_base (197)..(197): a, c, t, g, unknown or other
  misc_feature (197)..(197): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctcccaccctccctgtctgcatccattgganacagagtccacatcacttgccaggcgagtcgagggcatcaacttaagtatttaatggtatcagacaacaaaccgaggaccacgacccctaaactcctgactccgagtacctcgtacctaagtttacggaaacgtcggggtccctagtacggttcccgaggtacgggtaaggtcggggtcgtacggggtaacttcgttttctccttacgtccgtacaactacccaaaccctaacccgttacacggtaccctaagaaggtattacgggacggtacctaaactagttaacttaaccgttagttaccccaacggtaggttactacgtaaccgtacgttacccttaccccgtttaaccgtacccggtttcgggaacccggtaacgggggtaacccctaaagggtaacgaaacgttaacgtaaccgttaaacggtaaacgtcggaacggttccaccggaacctaacccttaacgttccttcggttaccctttaacgttaacctttcccccg

SEQ ID NO: 317203 - DNA, 594 bp, Homo sapiens
  misc_feature: GZ8MTXP01BYG5H.44.19.B08.1.454.CMB.2.raw
  modified_base (361)..(361): a, c, t, g, unknown or other
  misc_feature (361)..(361): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggcccccggaaaggccctggagtggatcgcactcacttatggaatgacgatatacgatatagtccttctctgacgacagactcacgctccacgaggacacgtaccaaaaaaacngtgtctacattgacacgtgaccctgtgacacgaggcactattatttctgtcgcccctacttacacttcggaacccaactaaacgttcggaacccgtacggggtacctttcgttacccggaaccccgttgggggaccctagggggaactcccgaacggttcctacccgttctccaattccgacgccctaacccaccgaacgggccctacgttccggttcccttcccccgtcggg

SEQ ID NO: 317204 - DNA, 593 bp, Homo sapiens
  misc_feature: GZ8MTXP01CW6OB.44.19.B08.1.454.CMB.2.raw
  modified_base (196)..(196): a, c, t, g, unknown or other
  misc_feature (196)..(196): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctcccaccctccctgtctgcatccattgganacagagtcaccatcacttgccaggcgagtcagggcatcaacttaagtaattaaatgtatcagacaacaaaccgacgggacacgtacccctaaactcctagactaccgaggtacctcgtactaagttacggaaacgtcgggtcctagacggtccgaggcggtaggtggtcgtagggtacttgtttctctctacgtcactacaaactacctacacgacgtagaacgtataggtacgacaagtattactactgtacacgtagtatacgacgtgttcccgtccttaccgtaccgtttcggacccgaacggggtaacccaaaggtaacgaacgttaactaaacgaaacgtacggtgacgggttcttcgaacctactctctacgttccttcgaactttccccg

SEQ ID NO: 317205 - DNA, 619 bp, Homo sapiens
  misc_feature: GZ8MTXP01C3XXK.44.19.B08.1.454.CMB.2.raw
  modified_base (370)..(370): a, c, t, g, unknown or other
  misc_feature (370)..(370): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagacagtatatacacgaccggtgctcgatttagtgagtcagtaagggggactcctgtgccccaccatggacacactttgctccacgctcctgctgctgaccatcccttcatggggcctgtccccagatcaccgtgaaagagtctggccctacattggtgaaacccacacagaccctcacgctgacctgcaccgtctcaggcttctcactcgtcactcctgggagagggcgttgtcgtgggtgcggcacggcccccggaaggccctggagtggatcgcactcacttagtggaatgacgatatacgatatagtccttctctgacgaccagactcacgctaccacggaagaccaacgtaccaaaaaaacgnggtcgtcttacattacgacctaacgtcggaccctggtacgacacgaggcaanattacgtttcngttcgaccctacttcactacggaaccaacgaaactcgaaccgacggggtcctttacggttaccggaacccgtgggggaccaacggggaacctccggaacggttccaacccggttctaccgattccgacgttccctaacccgaaccgaacgggccccacggttcccggtaacccgttccccgtcggg

SEQ ID NO: 317206 - DNA, 601 bp, Homo sapiens
  misc_feature: GZ8MTXP01ASGXP.44.19.B08.1.454.CMB.2.raw
  modified_base (261)..(261): a, c, t, g, unknown or other
  misc_feature (261)..(261): n is a, c, g, or t
tcagacagtatatacacgaccggtgctcgatttagtgagtcagtaagggggggtcacaagaggcagcgctctcgggacgtctccaccatggcctgggctctgctgctcctcactctcctcactcaggacacagggtcctgggcctagtctgccctgactcagcctgcctccgtgtctggttctcctggacagtcgatcaccatctcctgcactgggtccagcaaatgactagttggggatatataaccttgtctctggtancaacacatcaggacaaacgccccaaatcattacttttgactccagtgagcggccgtgaggttgtttctaatcgtccttctctggtctaccaaagtctcggccacgaccggtccctccgtgtcgtatctcgtcggctccggcctggacggacgaggtctagtacttattacgtcggcggggtcttactaactttacgtaacttcgttagacgttacggttggggttcggttccgggacgggtacgggtaacctcgaaccgtcggacccgttaccgtcggttcgaccggttcccgaagggtccctaacccggcccctcgggttcctaaccgttccgttcccg

SEQ ID NO: 317207 - DNA, 622 bp, Homo sapiens
  misc_feature: GZ8MTXP01DXKPD.44.19.B08.1.454.CMB.2.raw
  modified_base (207)..(207): a, c, t, g, unknown or other
  misc_feature (207)..(207): n is a, c, g, or t
  modified_base (450)..(450): a, c, t, g, unknown or other
  misc_feature (450)..(450): n is a, c, g, or t
tcagacagtatatacacgaccggtgctcgatttagtgagtcagtaagggggactcctgtgccccaccatggacacactttgctccacgctcctgctgctgaccatcccttcatggggccctgtcccagatcaccgtgaaagagtctggccctacattggtgaaacccacacagaccctcacgctgacctgcaccgtctcaggcttcncactcgtcactcctggagagggcgttgtcgtgggtgcggcacggcccccggaaagccctggagtggatcgcactcacttatggaatgacgatatacgatatacgtcttctctgacgaccagactcacgctacacgaagaccacgtaacccaaaaaaaaccgtggtcggtaccttaacacgttacgaacccgtaacgtcgggaccccttggtacggaaccacgaggcactattacttctgtacnccctattacattacggaacctaacaactcgaacccgacgggtcctttaccggttaaccgaacccgtgggggacccaagggtaactccgtaagggttccaccgttcactacgttaccgacgcccctaaccgaacccgaacgggcccctagttcccggtcccttccccgtcggg

SEQ ID NO: 317208 - DNA, 742 bp, Homo sapiens
  misc_feature: GZ8MTXP01AXY2K.44.19.B08.1.454.CMB.2.raw
  modified_base (227)..(227): a, c, t, g, unknown or other
  misc_feature (227)..(227): n is a, c, g, or t
  modified_base (280)..(280): a, c, t, g, unknown or other
  misc_feature (280)..(280): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtgggagngggtcgttgtcgtggggtgcggcacggccccccggaaaggccctggagtggancgcactcacttatggaatgacgatatacgatatagtccttctctgaccgaccagactcacgctacccacggaaggacaccgtaacccaaaaaaaccgtggtcggtacctacattcgaccgtaacggtcggacccctgtcgaaccacgacggccaactattaactttcgtgtaccgtacccctaacgtttccaacttcgggaaaccctaacgaaactccgggaaaccccgtaccgggggtccctttaccggtttaacccgggaaaccccggttcggggggaacccctaaacggggggtaaacccttccccggtaaacgggttccccgtaaacccggttccgttaacccaacgtttaccccgacccggttacccccgttaaccccgaaaccccgggaaaccgggggtccccccttaaaggttccccccggggtttcccccgttttccccccccggtcccggggg

SEQ ID NO: 317209 - DNA, 567 bp, Homo sapiens
  misc_feature: GZ8MTXP01A1UGK.44.19.B08.1.454.CMB.2.raw
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtagaaacccacacagaccctcacgctgacctgcaccgtctcagcttctcactcgtcactcctggagagggcgttgtctggggtgcggcacggccccccggaaaggccctggagtggatcgcactcacttattggaatgacgatatacgatatagtccttctctgacgaccagactcacgctccaacggaaggacaaccgtaccaaaaaaaaaccnggtcgtacctacattcgaaccaacggtcgaccctgtgacacaggacacattattctgtcnccctacttcatcgaccacaatcgaccacgggcttaccgttacgaaccctgggggaccaaggggaactccgaacggttcaccgttcactacacncgcccnccacgaacgggcccagttccggtccttccccgcgg

SEQ ID NO: 317210 - DNA, 664 bp, Homo sapiens
  misc_feature: GZ8MTXP01D5UPU.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctcccaccctccctgtctgcatccagttggagacagatcacatcacttgccgaggcgagtcgagggcatacaacttaagttaatttaaagtgtatcagacaacaaacgaggacacgacccctaaactctagactaccgagtactcgtacctaagttacggaaacgtacggggtaccgtacgtaaggttccaggtacgggtaaggtcggggtacgtaacggggtacttcggttttctccgttcgttacgtactactacaaacctaaccctagacgtcctaggaagtagttaggacgaactaactattacttacgtacgtacctaacggtagttagtacgactacgttccgttacccctttaacgtacccgtttcgggaccggtaacggggtaaccctaagggtaaacgaagttaacgtaaaccgaaacggtacgttcggttacggccttacggaacctaacccgttcttccgtacgttaccttaaccgttccgttcccg

SEQ ID NO: 317211 - DNA, 686 bp, Homo sapiens
  misc_feature: GZ8MTXP01CNK53.44.19.B08.1.454.CMB.2.raw
  modified_base (281)..(281): a, c, t, g, unknown or other
  misc_feature (281)..(281): n is a, c, g, or t
  modified_base (375)..(375): a, c, t, g, unknown or other
  misc_feature (375)..(375): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgccaccgtctcaggcttctcactcgtcactcctggagagggtcgttgtcgtggggtgcggcaccggccccccggaaaggcccgtggagtggancgcactcacttatggaatgacgatatacgatatagtccttctctgacgaccagactcacgctaccacgaaggacaaccgtaccaaaaaaaccgnggtcgtccttaacattacgaccaacggtcgaccctggtacgacacgaggcaacgtattactttctgtcgaccctacttcaacgttcggaaccctaactaacgtaccgaacccgtaccggggtccttttaccggtttaaccccggaaaccccggttcgggggacccctaagggggtaacctaacccggtaacgggttccctaccccggttcgtacctaacgttcccgaccgttacccccgttaaccccgaaccccggaaccggggtccccctacggttcccccgggttccccgtttccccccggtcccgggg

SEQ ID NO: 317212 - DNA, 664 bp, Homo sapiens
  misc_feature: GZ8MTXP01DULCM.44.19.B08.1.454.CMB.2.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (438)..(438): a, c, t, g, unknown or other
  misc_feature (438)..(438): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtccactcctggagagggcgttgtcgtggggtgcgggcacggccccccggaaggccctggagtggatcgcactcacttagtaggaatgacgatatacgatatagtccttctntcgacgacagactcacnctaccgacgaggacacgtaacccaaaaaacgngtcgtactanacttacgaccgacgtcggaccctgtacgacacgacggacatattactttctggtcnccctactttacaattacggaacctaactaacgttacgaacccgtaccgggtcctttacccggttaccggaaaccccggttgggggaacccggtaaaggggtaaccctaacccggtacgggttacccgtaacccgttcgaacctcttaccgaccgttaccccgtaacccgaaacccgaaccggggtcccctaccgttcccggttccccgtttcccccgggtcccggg

SEQ ID NO: 317213 - DNA, 549 bp, Homo sapiens
  misc_feature: GZ8MTXP01EE2IG.44.19.B08.1.454.CMB.2.raw
  modified_base (370)..(370): a, c, t, g, unknown or other
  misc_feature (370)..(370): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcaccggccccccggaaaggccctggagtggatcgcactcacttatggaatgaacgtatatacgatatacgtccttctctgacaccagactcacgctccaacggaagacacgtacccaaaaaacgnggtcgtctacattcgaccaagtcgaccctgaggacacgagcatattatttcngtcnccctattcatcggaaccanatcgaccgacggtcttcgtaccgaccgtggggacccagggactccgaggttcaccgttncattcncgcctccacgaacggcccagttccgtcccttcccgccgg

SEQ ID NO: 317214 - DNA, 696 bp, Homo sapiens
  misc_feature: GZ8MTXP01DV97R.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctcccaccctccctgtctgcatccattggagacagagtcaccatcacttgccaggcgagtcgagggcatactaactaagttaatttaaatggtatcagacaacaaaccgaggacacgacccctaaactcctagactaccgacgactaccgtaccttaagtttacggaaacgtacggggtacccgtacgtaacggttccgacggtacgggtaaggtcggggtacgtaacggggtaacttaaggtttttctccgttccgttcgtactactaccaaaccctaacccttacgacggtacctagggaaagtagtacggtagactaaactattaacttacgtactacccaacggtagttactacgaaccgttggttacccttcccctttaacgtacccggtttcggacccggtaacggggtaaccctaacggttaaagagttaaccgtaaaccgttaaacggtaacgttggttacggttcttacgtaaccctaacccgtttcgttccgttcgttacctttccttaaccgtttccccg

SEQ ID NO: 317215 - DNA, 696 bp, Homo sapiens
  misc_feature: GZ8MTXP01AWATL.44.19.B08.1.454.CMB.2.raw
  modified_base (412)..(412): a, c, t, g, unknown or other
  misc_feature (412)..(412): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctcccaccctccctgtctgcatccattggagacagagtcaccatcacttgccaggcgagtcgaggcatcaactaaagttatttaaatggtatcagacaacaaaccgagggaacacgaccccctaaactcctagactccgaggtacctcgtacctaaagtttcggaaaacgtcgggggtcccgtacgtaagggttccagggacgggaaggttgggggtacgtacgggggtaccttaacggtttttccncccgtttccgttacggtacctaacttacccaaaccctaaaccctacgaacggtaccgtaaggtaagtaattcgggtacggactaaacgtaattaactttactacgttaaccaccggtaaagtacgttacgacgtacgttaccgttaccccttaacgtacccgtttacgggacccgtaacgggggtaaaccaacgggtaacgtaacgaactaaccaaaacggtacgtaggttcggttcacggtccaaccgtcttacttccgtttacttcgttaaccgtttccccg

SEQ ID NO: 317216 - DNA, 694 bp, Homo sapiens
  misc_feature: GZ8MTXP01A3L5A.44.19.B08.1.454.CMB.2.raw
  modified_base (197)..(197): a, c, t, g, unknown or other
  misc_feature (197)..(197): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctcccaccctcctgtctgcactccattgganacagatcacatcacttgccgaggcgagtcgagggcatcaactaagttatttaaagtgtatcagacaacaaacgacggacacgacccctaactctagactacgagactcgtactaagttacggaaacgtacgggtcctacgtaggttaccaggacggtaaggtcgggtcgtaagggtaccttcggttttctcgttacctcgtactaactacctaaacctaaccgtacacgtaccgtagaaagtgttacgtacggaactaaactacgttaaacttaccgtacgtaaccctaaccgttaaggttaactacgtaaaccgttaccggtttaacccttccccgtttaaacttaccccgggtttaggaaaccccgggtaaacgggggtaaaccccctaaagggtaaagtaaacgttaaacgttaaacccgaaacggtaacgtcggttaacgccttacgaacctaacctcgtttcgtcttaccttaaccgttaaccgtttccccg

SEQ ID NO: 317217 - DNA, 541 bp, Homo sapiens
  misc_feature: GZ8MTXP01D2MYV.44.19.B08.1.454.CMB.2.raw
  modified_base (275)..(275): a, c, t, g, unknown or other
  misc_feature (275)..(275): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggancgcactcacttatggaatgacgatatacgatatagtcttctctgacgaccagactcacgctccacgaaggacacgtaccaaaaaacagtgtctacatgaccacgtgaccctgtgacacagcactatattctgtcgcccattcatcggacacaatcgaccgacggcttacgtaccgaaccgtggggacctaggggaactccgaggttccaccgttctcacttcgcgccctccaccgaacgggcccagttcccggtccttccccgcgg

SEQ ID NO: 317218 - DNA, 549 bp, Homo sapiens
  misc_feature: GZ8MTXP01DM6UN.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtatttaaaatggtatcagcacaaaccagggacagcccctaaatcctgactccaggactcgtcaaatttggaaacagggggtcctacgaaggttccaggtacggaagtggggtctaggggactaaggttttctcgtctcgtcatcaaacaaacctacagcctagaaagtatggtaggacaaacattaattaactgtcaaccagttatgacagtctacccttacacctttggcccaaggggacccaaagtgaagaactacaaaacggtaactgttacggcttgaaccacctaatcctgttcttcttaacttcc

SEQ ID NO: 317219 - DNA, 710 bp, Homo sapiens
  misc_feature: GZ8MTXP01CLNKZ.44.19.B08.1.454.CMB.2.raw
  modified_base (180)..(180): a, c, t, g, unknown or other
  misc_feature (180)..(180): n is a, c, g, or t
  modified_base (276)..(276): a, c, t, g, unknown or other
  misc_feature (276)..(276): n is a, c, g, or t
  modified_base (371)..(371): a, c, t, g, unknown or other
  misc_feature (371)..(371): n is a, c, g, or t
tcagacagtatatacacgaccggtgctcgatttagtgagtcagtaaggggggactcctgtgccccaccatggacacactttgctccacgctcctgctgctgaccatcccttcatggggcctgtcccagatcaccgtgaaagagtctggccctacattggtgaaacccacacagacccctnacgctgacctgcaccgtctcaggcttctcactcgtcactcctggagagggcgttgcgtgggtgcggcacggcccccggaaaggccctggagtggancgcactcacttattggatgacgatatacgatatacgtcttctctcgacaccagacctcacgctaccacggaagacgacgtaccaaaaaaaaccgnggtcggtacctaactacgttacgacctaacgtcgacccgtgtaggacacgacggacaactattactttcgtagtcgacccctactttaccacgttacggaaccctaaacgtaacgttacggacccgtaaccggggtcctttacccgttaccccgggtaaacccggttcgggggaacccgtaacgggggtaacccgtcccggtaaacgggttccccgtaaaccccggttccgttaccgacttacccgacccggttaccccgttccccgaaaccccggtaaaccggggcccccttaaaccggttccccgggttaaccccgtttccccccggttccccgggg

SEQ ID NO: 317220 - DNA, 649 bp, Homo sapiens
  misc_feature: GZ8MTXP01CZ5DH.44.19.B08.1.454.CMB.2.raw
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgccaccgtctcaggcttctcactcgtcactcctggagagggtcgttgtcgtgggtgcggcacggccccccggaaaggccctggagtggatcgcactcacttattggaatgacgatatacgatatacgtccttctctgacgaccagactcacgctaccacgaagacacgtacccaaaaaaaccgagtcggtacctacattacgaccgaacgtcggaccctgtaggacacgaggactaacattactttcgtcgtcgcccctattcactcggaacccaacaactcgaaccgtaccgggtcctttaccgtttacccggaacccggttcggggaccgaacggggtaacctccggtaacggttcccgtaacccggttcgttaccaacgttccgaccgttccccttaacccgaaacccggaaccgggtcccctacggttccccggtttcccgttccccccgtccgggg

SEQ ID NO: 317221 - DNA, 624 bp, Homo sapiens
  misc_feature: GZ8MTXP01AQ28Y.44.19.B08.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (446)..(446): a, c, t, g, unknown or other
  misc_feature (446)..(446): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtggagngggcgttgtcgtgggtgcggcaccggaccccccggaaggcccgtgggagtggancgcactctacttagtggaatgacgatatacgatatacgtccttctctgacaccagactcacgctaccgacggaacgacaccgtaaccaaaaaaacgnggtcgtaccttanacttacgaccgtaacggtcgaccctggtacggacacgaggactaatattactttcncgtacctaccctacttacactacggaacccaactaaacgtccggaacccgtaccgggtcctttacgttacccggacccggtcggggaccgaacgggacgtccgaaggttcccgaccgttcgactacttccgcgccctaaccgacgaacggccctacgttccgtcccgttccccgtcgg

SEQ ID NO: 317222 - DNA, 520 bp, Homo sapiens
  misc_feature: GZ8MTXP01D94LQ.44.19.B08.1.454.CMB.2.raw
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
  modified_base (514)..(514): a, c, t, g, unknown or other
  misc_feature (514)..(514): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtatttaaatgtatcagcaacaaaccaggacagcccctaaaactcctgatccaggactcgtaccaaatttggaaacaggggtccctanaacggttcaggcggaagtgggtctagggactaagttttctactctcgtacatacaaacaaacctanagctgaagatgtggacaacatatactgtcacagtatgacagtntccttacactttgccgaggggaccaaacgtaagaagatacaaaacgaactagttggcttggcaccaatctgttcttcttnttaacc

SEQ ID NO: 317223 - DNA, 739 bp, Homo sapiens
  misc_feature: GZ8MTXP01BE7V6.44.19.B08.1.454.CMB.2.raw
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggcctacattggtgaaacccacacagaccctcacgctgacctgcaccgtctcaggcttctcactcgtcactcctggagaggggcgttgtcgtgggtgcggcacggcccccggaaaggccctgggacgtggatcgcactcacttatgaatgacgatatacgatatagtccttntctcgacgacagactcacgctcccaacggacggactaaccgtaccaaaaaaaaacccgngggttcggtacccttaaacgtaactttacgaacccgtaaacggtacgggaaccccgttagtacggaccaacgagggaccaaccgtaattacgttttacttcggtacgacccctaacttcgtaacttacgggaacccaacgtaaacttaccggaaccgtaaccgggggtccctttaccgttacccggtaaacccggttcgggggaccctaaacgggggtaactcccggtaacggggttcccacccgggttacgtacccgtaacttacccgccgggttacccctttaaccccggaaaccccgaaccgggggtccccctaaaccggttaccccgggtttcccccgtttcccccggttcccccgggg

SEQ ID NO: 317224 - DNA, 775 bp, Homo sapiens
  misc_feature: GZ8MTXP01CVZ6G.44.19.B08.1.454.CMB.2.raw
  modified_base (179)..(179): a, c, t, g, unknown or other
  misc_feature (179)..(179): n is a, c, g, or t
  modified_base (712)..(712): a, c, t, g, unknown or other
  misc_feature (712)..(712): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtagaaacccacacagaccctnacgctgacctgccaccgtctcaggtcttctcactcgtcactccgtgggagagggtcgttgtcgtggggtcgcggaccaccggaccccccggaaaggcccgtgggagtggactcgacacgtactaacttagtaggaatgacgtaatagtaacgtattactacgttccttacgtacttacgaaccgaacctacgacctacgaccgtaccgtaccgaaaccggaaacgggaccctaaaacccggtaaaccccgaaaaaaaaaacccgttacgggttaaccggttaacctttaaacctaacgtttaaccggaaacccgtaaaccgggttcgggaaccccgttaggtaacgggaaccaaccggaacggtacctaaacgtatttaacgtttctacgggttacctacccctacttacaacttacgggaaacccacgtaaacgcgtaaccggtacggtccttaccgttacccgggaccggtcgggaaccgtagggaaccttaaccggacgggttacccaccggttctaacctacgttaccncgaccctaacccgaacggtaacccgggccctacggttccccggttccccgttccccggcccgg

SEQ ID NO: 317225 - DNA, 671 bp, Homo sapiens
  misc_feature: GZ8MTXP01A4X2C.44.19.B08.1.454.CMB.2.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtagaaacccacacacgaccctcacgctgacctgcaccgtctcaggcttcncactcgtcactccgtggagagggtcgttgtcgtgggtcgcggccgaccggacccccggaaggcccgtggagtgacncgcactctacttagtcgaagtgacgtaatactacgattacgtacttcttctcgtagaccgaccagactacacgctaccgacggaacgacaacgtaaccaaaaaacgtgtcgtactaactactacgaccgacgtacgtacctaggtacgacaacgacggactaagtactttacgtttactcggtaccacccttactactacgtacggaaaccctacgtaacgtaccgtaaaccgtccgggtacttaccggttaacccggaccggtacggggacccaagggtaccaaccggtcggttacctaccgttcgtacctacgttccgaccggttacccctaaccgtacccgaacccggtaccctccggttccgttcccccgttcccgtcccggg

SEQ ID NO: 317226 - DNA, 625 bp, Homo sapiens
  misc_feature: GZ8MTXP01BMJMA.44.19.B08.1.454.CMB.2.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
  modified_base (206)..(206): a, c, t, g, unknown or other
  misc_feature (206)..(206): n is a, c, g, or t
  modified_base (385)..(385): a, c, t, g, unknown or other
  misc_feature (385)..(385): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccanacagaccctnacgctgacctgcaccgtctcaggcttcncactcgtcactccgtggagagggtcttgtctggggtcgcggccacggaccccccgggaaaggccctggagtggatcgcactcacttatggaatgacgatatacgatatagtcctctctgacgacagactcacgctaccacgaagacaacgtaccaaaaaaaacctggtcgtaccttaanagttacgaaccaacggtcgaaccctggtacggacaacgaggaccaactattatttctaggtcctaccctacttacacgttacgggaaaccctaacgtaaactcgaacccgtacgggtccttaccgttacccgaacccgtgggggaccaggggaactccgtagggttccaaccgttctacagttcccgacgttccctaacccgaccgaacgggccccagttcccgtccgttccccgtccgg

SEQ ID NO: 317227 - DNA, 568 bp, Homo sapiens
  misc_feature: GZ8MTXP01CULRD.44.19.B08.1.454.CMB.2.raw
  modified_base (374)..(374): a, c, t, g, unknown or other
  misc_feature (374)..(374): n is a, c, g, or t
  modified_base (514)..(514): a, c, t, g, unknown or other
  misc_feature (514)..(514): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctggggtgcggcacggcccccccggaaaggccctggagtggatcgcactcacttattggaatgacgatatacgatatagtccttctctgacgaccagactcacgctacccacgaaggacacgtaccaaaaaaaaaaccgngggtcgtccttacattgaaccaacgtcggaccctgtcggacacgagcaacatatttctgtgcccattcatagacacaatgaccagggcttcgttaccgaaccgtgggacccgagggaatccgaggttccaccgttctacncttcgacgccctccacgttcaaacggggcccacgttcccggttctttccccccg

SEQ ID NO: 317228 - DNA, 734 bp, Homo sapiens
  misc_feature: GZ8MTXP01AUYZN.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctcccaccctccctgtctgcatccattggagacagagtcaccatcacttgccgaggcgagtcgagggacatacaacttaagttaatttaaagtggtatcagacaacgaaaccgaggaccaccgacccctaaactcctagactaccgagtacctcgtacctaagtttacggaaaccgggtacgggttcccgtagtaacgggttccgaacgggtacgggtaaggtcggggtacgtaaggggtactttcggttttcctccgttcgtccgtactaactaccaaactaaccctacgacgtaccgtaggaaacgtgtacggtacggaactaaacgtattaacgttactacgtaaccaaccggtaagttactacgtacgtacgttccgttaccccgttaacgttacccggttacgggaaccggtaaccggggtaaacccgtaaacggtaacggaacttaaaccggttaaaccgaaaaccgggttaacgttcgggttaccgggttccttaacggtccctaaacccgtttctttaccggttaccgtttcctttaaccgttaacccgttttccccccg

SEQ ID NO: 317229 - DNA, 707 bp, Homo sapiens
  misc_feature: GZ8MTXP01CWJNI.44.19.B08.1.454.CMB.2.raw
  modified_base (278)..(278): a, c, t, g, unknown or other
  misc_feature (278)..(278): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggtcgttgtcgtgggtgcggcaccggacccccggaaggcccgtggagtggancgcactcacttatgatgacatatacgatatacgttccttctctcgacgaccagactacacgctaccgacggaacgacaaccgtaacccgaaaaaaaaccgtcggtcggtacccttaacgacgttcgaacctaacggtcgaccctagtacggaacacgacggctaacgtatttactttactcgtacgtccctatttcacgtacggaacccacgtaaacgtccgtaacccgtacggtaccgtttaccgttaccggaaccccggttacgggggacccgtaaacggggtaacctaacccggtaacggttccgtaaaccccgttcgtaaacccgaccgtttacccgaccgttaccccgttaaccccgaaaccccggtaaccgggtccccttaaccgggttcccccgggtttcccctttccccccggtcccgggg

SEQ ID NO: 317230 - DNA, 552 bp, Homo sapiens
  misc_feature: GZ8MTXP01BGGD6.44.19.B08.1.454.CMB.2.raw
  modified_base (179)..(179): a, c, t, g, unknown or other
  misc_feature (179)..(179): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtagaaacccacacagaccctnacgctgacctgcaccgtctcaggcttctcactcgtcactccgtggagagggtcgttgtcgtgggtgcggcgaccggaccccccggaaaggccctggagtggatcgcactcacttatggaatgacgatatacgatatagtccttctctgacgacagactcacnctacacgagacactaccaaaaaacngtgtcctagattcgacacgtcgaccctgcgacagaggcactaagttctttacnggttcnccctaagttcatcgacanactcgacgtcggctttcgtaccgaccgtgggacaggactccgagttccacgttcactcncgcnccctaaccaccgtaacggccctagttcccggtcccttccccgtcgg

SEQ ID NO: 317231 - DNA, 524 bp, Homo sapiens
  misc_feature: GZ8MTXP02JFDSW.44.19.B08.1.454.CMB.2.raw
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctccacgaaggacacgtccaaaaaccnggtggtccttacattgaccaacgtgaccctgtgacacaggcacatattctgtgcccattcatgaccanaatgaccacggcttcttcgaacctgggccagggaatcgaggtcaccgtctcactcagcctccgaccaacgggcccagtccggtcttcccccgtgg

SEQ ID NO: 317232 - DNA, 534 bp, Homo sapiens
  misc_feature: GZ8MTXP02GR0FY.44.19.B08.1.454.CMB.2.raw
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
  modified_base (488)..(488): a, c, t, g, unknown or other
  misc_feature (488)..(488): n is a, c, g, or t
  modified_base (531)..(531): a, c, t, g, unknown or other
  misc_feature (531)..(531): n is a, c, g, or t
tcagacagtatatacacgaccggtgctcgatttagtgagtcagtaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggatcgcactcacttattggaatgacgatatacgatatagtccttctctgacgaccagactcacgctccacgaaggacacgtaccaaaaaccnggtcggtccttacattgaccaacgtgaccctgtggacacaggcacatatttctgtcgcccacttcatcgaccanaatgaccacggcttctcgaaccctgggccagggaactccgaggcaccgtcncactcacgcctccgaccaacgggcccagtccggtccttccccncgg

SEQ ID NO: 317233 - DNA, 512 bp, Homo sapiens
  misc_feature: GZ8MTXP02IOJOH.44.19.B08.1.454.CMB.2.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (412)..(412): a, c, t, g, unknown or other
  misc_feature (412)..(412): n is a, c, g, or t
tcagacagtatatacacgaccggtgctcgatttagtgagtcagtaaggggcaggagtcagtcccaaccaggacacagcatggacatgagggtccctgctcagctcctggggctcctgctgctctggctctcaggtgccagatgtgacatccagatgacccagtctccacctccctgtctgcatccattggagacagagtcaccatcacttgccaggcgagtcagggcatcactaagtattaaatgtatcagcacaaacaggacagacccctaaatcctgatccaggactcgtaccaatttggaaacnggggtccctagaaggtccagcgaagtgggtctgggactgtttcnctctcgtcatcaacaactacagcctagagatgtcggacaacatattactagtcaccagtangactagtctaccttactacgtttggccgaggggacccaagtacgagactacgaaacgtaacgtgtacggctacgcacctatcctgtccttcactttcccg

SEQ ID NO: 317234 - DNA, 823 bp, Homo sapiens
  misc_feature: GZ8MTXP02IY967.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattgganacagagtcaccatcacttgccaggcgagtcagggcatcactaagtattaattggtatcagcacaaaccaggacagacccctaaactcctagactccgaggacctcgtaccctaaagtttacggaaaaccgtacgggggttaccccgtacgtaaacggggtttccccgaacggtaccggggtaaagggttcggggtacgttacgggggtaaccttacggggttttttcctccgtttccgttccggttacctaacgttaccctaaaaccctaaacccccgttaacaaccgggtaccccttaaggaaaagttaacgttgggttacgggaacctaaaaccggtaatttaaacgtttaacccttacgggttaaccctaaaccccgtaaagggttttaactaccggtaaacccgttaacgggtttaccccgttacccccttttaaccgtaaccccggtttttacgggggaacccccgaaacggggggtaaacccctaaaaccggggtttaaagaacgggtaaaccttaaacccgaaaaaccggtaaaccctttcggggttacgggacccttaacggccccgtaaaccgtaactttcccgtttcggtttaccctttacgtacccgttttcccccg

SEQ ID NO: 317235 - DNA, 528 bp, Homo sapiens
  misc_feature: GZ8MTXP02FY8NJ.44.19.B08.1.454.CMB.2.raw
  modified_base (361)..(361): a, c, t, g, unknown or other
  misc_feature (361)..(361): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttctctgacgaccagactcacgctccacgagacacgtaccaaaaaccnggtgtccttacattgaccaacgtggaccctgtggacacaggcacatatttctgtcgcccacttcatgaccacaatcgaccacgggcttctcgaccctgggccagggactccaggtcaccgtctcactcagcctccaccgaacggcccagtccggtccttcccctcgg

SEQ ID NO: 317236 - DNA, 526 bp, Homo sapiens
  misc_feature: GZ8MTXP02HKSCY.44.19.B08.1.454.CMB.2.raw
  modified_base (255)..(255): a, c, t, g, unknown or other
  misc_feature (255)..(255): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagacagtatatacacgaccggtgctcgatttagtgagtcagtaaggggcaggagtcagtcccaaccaggacacagcatggacatgagggtccctgctcagctcctggggctcctgctgctctggctctcaggtgccagatgtgacatccagatgacccagtctccaccctcctgtctgcatccattggagacagagtcaccatcacttgccaggcgagtcagggcatcactaagtattaaattggatcagcanaaaccaggacagcccctaaactcctagatccaggactcgtccaaatttggaaacaggggtccctcaaaggttccagcggaagtgggtctggggactgttttcnctctcgtcatcaaacaacctacgacnctagantgacgacaactatatacgtntacactagtancgactagtacgtacctactacgttacgtacgacggaacgaacgtaacgagactaacaaacgaaacgtacgtacgtacgacgaacgacactactctcttactactc

SEQ ID NO: 317237 - DNA, 567 bp, Homo sapiens
  misc_feature: GZ8MTXP02JPQGD.44.19.B08.1.454.CMB.2.raw
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (354)..(354): a, c, t, g, unknown or other
  misc_feature (354)..(354): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaaattggtatcagcacaaacaggacagcccctaaactcctgatccaggactcgtaccaatttggaaacnggggtccctanaggtccagcggaagtgggctgggactgtttcnctctcgtcatcaaacaacctacagcctagaacgatgtaggacaactatattactgtcacagtatgactagttcgtacccttactaccgtttcggaccgtagggggaacccaaacggtaggaacgtaactaaccgaaaacggtaaccgttaggtacggtacctaggaacccgtaaccctaattccgtacgttccctttaccgacgtttcccccg

SEQ ID NO: 317238 - DNA, 543 bp, Homo sapiens
  misc_feature: GZ8MTXP02JHKJG.44.19.B08.1.454.CMB.2.raw
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggacgtggatcgcactcacttatggaatgacgatatacgatatagtccttctctgacgaccagactcacgctccacgaaggacacgtccaaaaaccnggtcggtccttacattcgaccaacggtcgaccctgtggacacgaggcanatatttctgtgcccattcatgaccacatcgaccacgggcttcgtcgaaccgtgggccagggaactccgaggtccaccgtctcactcacgccctccgaccgaacgggcccacgtccggtccttccccgtcgg

SEQ ID NO: 317239 - DNA, 525 bp, Homo sapiens
  misc_feature: GZ8MTXP02HQ3U8.44.19.B08.1.454.CMB.2.raw
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaaattggtatcagcacaaaccaggacagacccctaaactccctagactccaggactcgtaccaaatttaggaaacacggggtccctacgaaggttccagcggaagtggggtctgggacngttttctctctcgtcatacaacaacctacagacctagaagatgtagcaaacatatactagtcacagttangactagtctacctactacgttcgaccgacgggaccaagtacgaagactaacaaacgtaactcgtacgctacgaacacactctgtcttactactc

SEQ ID NO: 317240 - DNA, 587 bp, Homo sapiens
  misc_feature: GZ8MTXP02INIQW.44.19.B08.1.454.CMB.2.raw
  modified_base (359)..(359): a, c, t, g, unknown or other
  misc_feature (359)..(359): n is a, c, g, or t
  modified_base (430)..(430): a, c, t, g, unknown or other
  misc_feature (430)..(430): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttctctgacgaccagactcacgctccacgaagacacgtacaaaacngtcgtctacattgaccacgtgaccctgtgacacaggcacattacttcgtgtcgcccacttcatcgacccanaatcgacccgacgggtccttaccgttaccgaacccgttcggggaccgaaggggaacttcccgacgggttccacccggttctacctactccaacggccctaacccgaacccgaaacggggcccccaagttccccgggttccctttcccccggtccggg

SEQ ID NO: 317241 - DNA, 509 bp, Homo sapiens
  misc_feature: GZ8MTXP02GSCX3.44.19.B08.1.454.CMB.2.raw
  modified_base (360)..(360): a, c, t, g, unknown or other
  misc_feature (360)..(360): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaaatgtatcagcacaaacagggacagcccctaaactcctgactccaggactcgtaccaaatttggaaacaggggtccgtacaaggttccagcggaagtgggtctagggactgttttcnctctcgtcatcaaacaacctacagcctagaagatgtggcaaacatattactgtacacctagtatgacagtctacccttacacctttggccaggggaccaacggtagagatacaaaagactgtacgctgcaccatctagtctacattccc

SEQ ID NO: 317242 - DNA, 553 bp, Homo sapiens
  misc_feature: GZ8MTXP02G10KR.44.19.B08.1.454.CMB.2.raw
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttctctgacgacagactcacgctccacgaagacacgtacaaaacngtgtctacatgacacgtcgacctgngacacaggcacatattctgtcgacccacttcatacgacctacaatcgaaccacgggtccttacgtaccgaacccgtggggaccgaaggggaactccgacggtccaccgtctacactaccacgccctaacccgaccgaacgggccccacgtccggtcccttccccgtccgg

SEQ ID NO: 317243 - DNA, 580 bp, Homo sapiens
  misc_feature: GZ8MTXP02G88BV.44.19.B08.1.454.CMB.2.raw
  modified_base (363)..(363): a, c, t, g, unknown or other
  misc_feature (363)..(363): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccacctccctgtctgcatccattggagacagagtcaccatcacttgccaggcgagtcagggcatcactaagtattaaatggtatcagcacaaaccaggacagcccctaaatcctgatccaggactcgtacctaatttcggaaacaggggtccctagaaggttccaggcggaagtcggggtctaggggactgttttcnctctcgtcatcaaacacctacagcctagaagatgtcggacaacatattactagtcacctagtatgactaaggttctacccttacaccgttttcgggacccgtaagggggaccccaaaggttagaacggtaacttaccggaaaaacgaaccgttggtacgggacttaggaacccaacccgtaattcccttagtttccctttaccgaacttttcccccg

SEQ ID NO: 317244 - DNA, 540 bp, Homo sapiens
  misc_feature: GZ8MTXP02JJ11P.44.19.B08.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagacagtatatacacgaccggtgctcgatttagtgagtcagtaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtncggcagccccccggaaaggccctggagtggatcgcactcacttattggaatgacgatatacgatatagtccttcnctgacgacagactcacgctccacgaagacacgtaccaaaaccaggtgtccttacattgaccaacgtgaccctgtcgacacaggcacatattctagtcgcccacttcatagacctacaatcgaaccacggggctttcttcgaaccctcggggaccaggggaactccgacggtacaccgtctacactcacgcctccgaccgaacggcccagtccgtcttcccctcgg

SEQ ID NO: 317245 - DNA, 565 bp, Homo sapiens
  misc_feature: GZ8MTXP02GXVS5.44.19.B08.1.454.CMB.2.raw
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (562)..(562): a, c, t, g, unknown or other
  misc_feature (562)..(562): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggatcgcactcacttattggaatgacgatatacgatatagtcctttctctgacgaccagactcacgctaccacgaacggacaacgtaccaaaaaacgngggtcggtaccttacacttacgacctaacggtcgaaccctgtcggacacaggcacattattctgtcnccctacttcatcgaccaacaatcgaccacgggtctcgttcgaacccgtgggaccagggactccgaggtcaccgtctacactccacgcctaaccgaccgaacggcccacgtccggtccctttccccncgg

SEQ ID NO: 317246 - DNA, 594 bp, Homo sapiens
  misc_feature: GZ8MTXP02FWXWC.44.19.B08.1.454.CMB.2.raw
  modified_base (360)..(360): a, c, t, g, unknown or other
  misc_feature (360)..(360): n is a, c, g, or t
  modified_base (545)..(545): a, c, t, g, unknown or other
  misc_feature (545)..(545): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgcccccggaaaggccctggagtggatcgcactcacttatggaatgacgatatacgatatagtccttctctgacgaccagactcacgctccacgaagacacgtaccaaaaaccnggtggtccttacattcgaccaacgtggaccctgtggaccacgaggcacatatttctgtgaccccactttccatcgaaccctacaatcggacccacggggcctttacgtaccggtaaaccccgtgggggacccaacggggaacttccgaacgggtccaccggtaccttacaacttcaacgtccccncccgaacccaaacggggccccaagttccggtccctttcccccgtccggg

SEQ ID NO: 317247 - DNA, 738 bp, Homo sapiens
  misc_feature: GZ8MTXP02IC54L.44.19.B08.1.454.CMB.2.raw
  modified_base (194)..(194): a, c, t, g, unknown or other
  misc_feature (194)..(194): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattgganacagagtcacatcacttgccaggcgagtcagggcatcactaagtattaaatgatcagacacaaaccaggacacgacccctaaactcctagactccgaggtacctcgtaccctaaagtttacggaaaaccgtacgggggttacccctagtaaacgggtttcccgaagggtaccggggtaaggttcggggttcgttacgggggtacctttacgggtttttttcctacgtttcccgtttaccggttacctaacgtttaaccaaaacccgtaaacccttaacgacgtacccgttaggaaaacgtagttaggtacggaacctaaacgtaatttaacgtttacctacgttaccaaacctaaggttatacgtaacgtacgttccgttacccctttaacgtacccggttttcgggacccggtaacgggggtaaaccctaaaacgggttaaggaacggttaactaaaccgaaaaacggtacgttaggtacggtacctacggaacccgtaaccctagttaccgttacgtttccctttacgtaacctttcccccg

SEQ ID NO: 317248 - DNA, 541 bp, Homo sapiens
  misc_feature: GZ8MTXP02JIGED.44.19.B08.1.454.CMB.2.raw
  modified_base (363)..(363): a, c, t, g, unknown or other
  misc_feature (363)..(363): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggacgtggatcgcactcacttattggaatgacgatatacgatatagtccttctctgacgacagactcacgctccacgaaggacacgtaccaaaaaccngtcggtccttacattgaccaacgtcggaccctgtcggacacaggcacatatttctgtcgcccacttccatcgaccacaatgaccacggcttcgttcgaaccctgggccagggactccgaggtcaccgtctcgactcacgcctccaccgaacgggtcccatccggtcctttccccgcgg

SEQ ID NO: 317249 - DNA, 557 bp, Homo sapiens
  misc_feature: GZ8MTXP02JVEFD.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcaggggcatcactaagtattaaattggtatcagcacaaaccagggacacgcccctaaactcctgactccaggactcgtaccaatttggaaacaggggtccctacgaaggtccagcggaagtgggtcgtgggactggttttctctctcgtcatcaaacaacctacagccctagaacgatgtggactaaacatattactgtacactagtatgactagttcgtccccttactacccgtttggacccgaacgggggaacccaaacggtacggacgtaactacgaaaacgtaacttgtacggcttacgccgacctaactctcgttcttacactttcccc

SEQ ID NO: 317250 - DNA, 655 bp, Homo sapiens
  misc_feature: GZ8MTXP02F60WP.44.19.B08.1.454.CMB.2.raw
  modified_base (364)..(364): a, c, t, g, unknown or other
  misc_feature (364)..(364): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggatcgcactcacttattggaatgacgatatacgatatagtccttctctgacgaccagactcacgctccacgaaggacacgtaccaaaaaccnggtggtcctacattcgaccaacgtgaccctgtggacacaggcaacatatttctagtcgacccactttcatcgacccaacaaattcgaacccaaccggggtctttccgtttaccggaaaccccgttcgggggacccgtaagggggaacttacccgacggggttacccaacccgggttcttaccgaacttacccgaacggtacccccttaaccccgaaaccccgtaaaaccgggggacccccctaaacggtttccccggggtttacccctttacccccccggtttcccggggg

SEQ ID NO: 317251 - DNA, 576 bp, Homo sapiens
  misc_feature: GZ8MTXP02H87GX.44.19.B08.1.454.CMB.2.raw
  modified_base (194)..(194): a, c, t, g, unknown or other
  misc_feature (194)..(194): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattgganacagagtcacatcacttgccaggcgagtcagggcatcactaagtattaaattggtatcagacacaaaccgaggacacgacccctaaactcctagactaccaggacctcgtacctaaagtttaggaaacgacggggttacccgtacgaaggttcccaggtaccggtaagtggggtacgtggggacttagttttctctcgttcgtcatacaaacaaccctacagtacctagaagactaggtagacaaacattacttactgtacacagttatgacagtacgttacccttactaccgtttcggaccgaggggaaccaaacggtagaagtacgaaacaaacgacgttagtcggactacgaacacctatctgtcctttacactttccc

SEQ ID NO: 317252 - DNA, 521 bp, Homo sapiens
  misc_feature: GZ8MTXP02JNJ8A.44.19.B08.1.454.CMB.2.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (426)..(426): a, c, t, g, unknown or other
  misc_feature (426)..(426): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtncggcagccccccggaaaggccctggagtggatcgcactcacttattggaatgacgatatacgatatagtccttctctgacgacagactcacgctccacgaaggacacgtaccaaaaacngtgtccttacattgaccaacgtgaccctgtgacacaggcacatattctgtgcccattcatgaccanaatgaccacgggcttcttcgaacccgtgggccagggatccgaggtcaccgtctcactcacgcctcaccaacggcccagtccggtccttccctcgg

SEQ ID NO: 317253 - DNA, 538 bp, Homo sapiens
  misc_feature: GZ8MTXP02F317T.44.19.B08.1.454.CMB.2.raw
  modified_base (363)..(363): a, c, t, g, unknown or other
  misc_feature (363)..(363): n is a, c, g, or t
  modified_base (415)..(415): a, c, t, g, unknown or other
  misc_feature (415)..(415): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctggggtgcggcacgccccccggaaaggccctggagtggatcgcactcacttatggaatgacgatatacgatatagtccttctctgacgaccagactcacgctccacgaaggacacgtaccaaaaaccnggtcgtccttacattcgaccaacgtgaccctgtggacacagcacatctttcngtcgcccacttcatgaccacaatcgaaccacggcttctcgaacctgggaccagggactccgaggtcacgtctcactcagccctccgaacccgaacgggcccagtccggtaccttccccgtcgg

SEQ ID NO: 317254 - DNA, 806 bp, Homo sapiens
  misc_feature: GZ8MTXP02F3SA3.44.19.B08.1.454.CMB.2.raw
  modified_base (194)..(194): a, c, t, g, unknown or other
  misc_feature (194)..(194): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattgganacagagtcaccatcacttgccaggcgagtcaggggcatcactaagtatttaaattggtatcagacaacaaaccgagggacacgaccccctaaactcctagactccaggacctcgtaccctaaatttacgggaaacgtacggggtcccgtacgtaacgggttcccaggccgggtaaaggtcggggttacgtagggggtaacttacggggttttttcctccgtttccgttccggttacctaacgtttaacccaaaacccgtaaaacccctttaaacgaaaccggtaccccgttaaggaaaacggtaacgttagggttacggggaaccctaaaaccgttaatttaaaacgtttaacccttaggtttaaccccaaacccgtaaagggtttaacttacggtaaaccgttaacgggttacccgtttaccccctttaaaccgttaaccccgtttttacggggacccccggtaaacggggggtaaccccctaaaaggtttaacgggaaacgttaaacgttaacccggaaaaaaccgtaaccgttagggtaacgggtccttacggaacccgtaacccgtaacgttaccgttcgtttacctttacctaaccgttttcccccg

SEQ ID NO: 317255 - DNA, 552 bp, Homo sapiens
  misc_feature: GZ8MTXP02F9H8R.44.19.B08.1.454.CMB.2.raw
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggatcgcactcacttattggaatgacgatatacgatatagtccttctctgacgaccagactcacgctccacgaaggacacgtaccaaaaaccnggtcggtccttacattcgaccaacgtggaccctgtgacacaggcacatatttctgtncccattcatcgaccacaatcgaccacgggtcttcttcgaacccgtggggaccagggaactccgaggtccaccgtctcgactcgacgccctaaccaccgaacgggccccacgtccggtccctcccccgtcgg

SEQ ID NO: 317256 - DNA, 797 bp, Homo sapiens
  misc_feature: GZ8MTXP02HRVXG.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattgganacagagtcaccatcacttgccaggcgagtcagggcatcaactaagtatttaaattggtatcaagcacaaaccgagggacacgaccccctaaatcctagactaccaggtacctcggtaccctaaagtttacgggaaaacgtacgggggttaccccgtacgtaaaaggggtttcccgaacggggtaccgggtaaagggttcgggggttaccgtacgggggttaaccttacggggtttttttccctcgtttacccgttcccggttacctaaccgtttaaaccaaaacccccgtaaaacccgtttaaaccaaacccggttaccccggttaaaggaaaacggttaaacggttttacggtacggggtaaacctaaaaccgtaattttaaacttttaaccttacggtttaccctaaacccgtaggtttaaaccttaggaacccgttaagttcccggttaccccctttaaacgttacccgttttacggggaccccgtaagggggtaaaccccctaaaggttaagaaacggtactaaacgaaaaccgtaacgttcggaggtaaccttcgaaccgtaacctacgttactcgttacctttactacctttcccg

SEQ ID NO: 317257 - DNA, 534 bp, Homo sapiens
  misc_feature: GZ8MTXP02GAT5H.44.19.B08.1.454.CMB.2.raw
  modified_base (237)..(237): a, c, t, g, unknown or other
  misc_feature (237)..(237): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggganatataaccttgtctctgtatcaacaacatccaggacaaacgcccccaaatcatacttttgagtccagtgagcggcgtcgaggtgtttactaatcgtccttctctggtctccagtctggccacaccggcctcctgtcgatctcgtcggctccggcctgacggacgnggctgactattactcgcggtntctattacacttctgtagtacgttgggtgttcggacgggaggactcgacgtcgacccgtcgtacgtcacgccgaaggtcctccgccccgttacggtcctacgtccttcccg

SEQ ID NO: 317258 - DNA, 540 bp, Homo sapiens
  misc_feature: GZ8MTXP02GJJR6.44.19.B08.1.454.CMB.2.raw
  modified_base (241)..(241): a, c, t, g, unknown or other
  misc_feature (241)..(241): n is a, c, g, or t
  modified_base (363)..(363): a, c, t, g, unknown or other
  misc_feature (363)..(363): n is a, c, g, or t
  modified_base (499)..(499): a, c, t, g, unknown or other
  misc_feature (499)..(499): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcttgtctggggtncggcaggccccccggaaaggccctggagtggatcgcactcacttattggaatgacgatatacgatatagtcctttctctgacgaccagactcacgctccacgaagacacgtaccaaaaaccnggtcggtccttaacattagaccaaacgtggaccctgtgacacaggcacatatttctgtgcccattcatgacacaatgaccacggcttctcgaacctgggccagggaactccaggtccaccgtctacactcactccnccaaccgaaacgggccccaagtccggtccttcccccgtcgg

SEQ ID NO: 317259 - DNA, 549 bp, Homo sapiens
  misc_feature: GZ8MTXP02JLLTR.44.19.B08.1.454.CMB.2.raw
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttctctgacgaccagactcacgctccacgaagacaacgtaccaaaaaccgngtcggtccttaacattacgaccaaacggtcgaaccctgtgaccanaggcacatattctgtnccacttcatgactanaatcgaccacggcttcgtacgaaccgtggggaccagggactaccgacggtcaaccgtctctacncacgcccncacccgaaagggccccatccggtcccttccccgtcgg

SEQ ID NO: 317260 - DNA, 599 bp, Homo sapiens
  misc_feature: GZ8MTXP02H8SCN.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccacccctcctgtctgcatccattgganacagagtcacatcacttgccaggcgagtcgagggcatcaacttaagtattaaattgtatcagacaacaaaccgaggacagacccctaaactctgactccgagactcgtacaagtttaggaaacgacggggtacccgtagtaaggttccgaggacggtaagtcgggtcgtaggggacttagtttctctctcgtacactacaaaccaacctacacgtcctagaagataggtaggacaaacgtattacttactgtaccaaccgtaagttactagactacgttcgttaccccttaacgtaccgtttacggaccgtaacggggaacccaaacggttagaacgtactaacgaaaacgtacgtacgcggtacacgaacgtaccaattctgtttacctacgtaacttccccg

SEQ ID NO: 317261 - DNA, 648 bp, Homo sapiens
  misc_feature: GZ8MTXP02JCLC0.44.19.B08.1.454.CMB.2.raw
  modified_base (357)..(357): a, c, t, g, unknown or other
  misc_feature (357)..(357): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttatggaatgacgatatacgatatagtccttctctgacgaccagactcacgctcacgagacacgtacaaaaccnggtcgtcctacattgaccaacgtgaccctgtggacacgaggcacgatactttctgttcgccccactttccacttgaaccccaacaaacttcgaaccccgaacggggtcctttaccgtttaccggaaaccccgttcgggggaccccaagggggaaaacctttacccgaacggggtttcccaaaccccggttcctaccgtaacttacccgacggtacccccttaaccccgaacccccgaaaacgggggcccccaagtttccccggggttacccctttcccccccgttccgggg

SEQ ID NO: 317262 - DNA, 530 bp, Homo sapiens
  misc_feature: GZ8MTXP02IHE7U.44.19.B08.1.454.CMB.2.raw
  modified_base (207)..(207): a, c, t, g, unknown or other
  misc_feature (207)..(207): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaaccccacacagaccctcacgctgacctgcaccgtctcaggcttcncactcgtcactcctggagagggcgttgtctgggtgcggcacggccccccggaaaggccctggagtggatcgcactcacttatggaatgacgatatacgatatagtcttctctgacgacagactcacgctcacgagacacgtacaaaaccgngtcggtcttacattgaccaagtgacctgtgacacagcacatattcngtcnccattcatgaccanatgaccaggcttctcgacctgggccagggactaccgaggtccacgtctacacgtacacgccctaaccgaccgaaacgggccctaacgtccggttcccttccccgtcgg

SEQ ID NO: 317263 - DNA, 586 bp, Homo sapiens
  misc_feature: GZ8MTXP02HL7FP.44.19.B08.1.454.CMB.2.raw
  modified_base (361)..(361): a, c, t, g, unknown or other
  misc_feature (361)..(361): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaaccccacacagaccctcacgctgacctgcaccgtctcaggcttctcactcgtcactcctggagagggcgttgtctgggtgcggcacggccccccggaaagccctggagtggatcgcactcacttatggaatgacgatatacgatatagtcttctctgacacagactcacgctccaacgaagacaacgtaccaaaaaccnggtcggtaccttacattacgacctaacgtgaccctgtagacacaggcaatatatttctgtcgaccctacttcagtactacccaacaactcggaacccgacgggtccttacgttaccgaacccgtcggggacccgaagggaacctccgtacgggtccaccggttactcacgtccacgcctaaccaacccgtacgggacccctagtcccggtccctttccccgccgg

SEQ ID NO: 317264 - DNA, 557 bp, Homo sapiens
  misc_feature: GZ8MTXP02GX2LA.44.19.B08.1.454.CMB.2.raw
  modified_base (365)..(365): a, c, t, g, unknown or other
  misc_feature (365)..(365): n is a, c, g, or t
  modified_base (450)..(450): a, c, t, g, unknown or other
  misc_feature (450)..(450): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcacggccccccggaaaggccctggagtggatcgcactcacttagttggaatgacgatatacgatatagtcttctctgacgaccagactcacgctaccacgaagacacgtaccaaaaccgnggtcgtacctacattacgaacctaacgtcgaccctgtacgacacgaggacatattacttcgtgtcgaccctactcatcgaaccanaatcgaccgacggtcttacgtccgaaccgtggggaccagggactccgaggtccaccgtctcactccacgcctaaccgaccgacggcccacgtccgtccctcccgtcg

SEQ ID NO: 317265 - DNA, 697 bp, Homo sapiens
  misc_feature: GZ8MTXP02J4SQU.44.19.B08.1.454.CMB.2.raw
  modified_base (411)..(411): a, c, t, g, unknown or other
  misc_feature (411)..(411): n is a, c, g, or t
  modified_base (456)..(456): a, c, t, g, unknown or other
  misc_feature (456)..(456): n is a, c, g, or t
  modified_base (488)..(488): a, c, t, g, unknown or other
  misc_feature (488)..(488): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattggagacagacgtcaccatcacttgccaggcgagtcagggcatcactaagtattaaattggtatcagcacaaccacgggacagcccctaaactacctgactccacggaactcgtacctaatttacgggtaaaccgaggggttccccggtaccgtacggttaccgtgacggtcgggaagggtttcgggtacggttggtacgttttctttcctccttcttacnctacaacccaaaccctacggaccagacgtagaagtaggttacggngaaccaattaattacggttctaacgttacccnttacgtacaacgggtctacgggttaccctttaccccgtacctttaaacccggggtaccgttaccggggggtaacctaaaacccggggggtaaacgtaaacggtaacgtaaaaccggtaaaaccgttaaccgtaaaccgggttacggtccggttaccggaacctaccgtaccgttaccttaccgttcctttaccgtttaccgtttacccg

SEQ ID NO: 317266 - DNA, 551 bp, Homo sapiens
  misc_feature: GZ8MTXP02IW1RJ.44.19.B08.1.454.CMB.2.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (528)..(528): a, c, t, g, unknown or other
  misc_feature (528)..(528): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattgganacagagtcaccatcacttgccaggcgagtcagggcactcataagtattaagtgtatcagacaaccaacgaggacacgaccctaactctagactacgagactcgtactagttacgaacgtcggtccagtagtcagagagtggtcgtggactgtttcnctcgtcgtcatacaaacactnacgctagaacgtgtggtacgacaactatacttctagtaccctagtaagtctacggtactacggttacccgtaccttaacgttcgttacggaccggtaaacgggactaacggtagactaacgaaccgaaaagtaccgtgacgtctacgctaaaccttnttcgtacttctactaccttcccg

SEQ ID NO: 317267 - DNA, 520 bp, Homo sapiens
  misc_feature: GZ8MTXP02IAUFE.44.19.B08.1.454.CMB.2.raw
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (473)..(473): a, c, t, g, unknown or other
  misc_feature (473)..(473): n is a, c, g, or t
tcagacagtatatacacgaccggtgctcgatttagtgagtcagtaaggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtatttaaatggtatcagcacaaaccagggacagcccctaaatcctgactccaggactcgtaccaatttggaaactaggggtccctcaaaggttcccaagcggaagtggggtctaggggactggtttttccnctacttcgtcaatcaaacaacctanacgacctgaaagatgtaggcaacatattactgtaccacagtatgacagtctccttacactttggccaggggacaacgtanagatacaaaacgaactgacggctagcacactctgtcttacacttccc

SEQ ID NO: 317268 - DNA, 552 bp, Homo sapiens
  misc_feature: GZ8MTXP02HLJ04.44.19.B08.1.454.CMB.2.raw
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggccccccggaaaggccctggagtggatcgcactcacttattggaatgacgatatacgatatagtccttctctgacgacagactcacgctccacgaagacacgtaccaaaaaccgnggtcgtaccttaacattacgaccaacgtcggaccctgtcgacacaggcacgatattcngtcgacccacttcatcgaacctanaatcgaccacggtcttacgtcgaaccgtggggacctagggaactccgacggtcaccgtctacactcacgcctaaccgacgaacggcccagtccgtccttccccgcgg

SEQ ID NO: 317269 - DNA, 699 bp, Homo sapiens
  misc_feature: GZ8MTXP02ILUR3.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattgganacagatcacatcacttgccaggcgagtcgaggcatcaactaagtattaatgtatcagcaacaaacaggacacgacccctaaatccagactaccgagtactcgtacctaaagtttacggaaacgtacggggtaccccgtagtaaggttcccaggtcggtaaaggttcggggtcgtaggggtaaccttaggtttttcctcttccgttccgttacctacttaccaaacccaaacccttacaacgtacccgttaagaaagtacgttaggttacggaacctaaaacgttaattaactttaaccgtacggttacctaaacccgtaggttaactacggtaaccgtaacgttccgttaaccccctttaacgtacccgttttacggggaccccgtaacgggggtaaaccctaaaacgggttgaaaacgtaacgtaaaccgtaaaaacggtacgttacggtccggtaactcggaacctaacgtacttcttacgttccttactaacgtttccccg

SEQ ID NO: 317270 - DNA, 557 bp, Homo sapiens
  misc_feature: GZ8MTXP02GJHVU.44.19.B08.1.454.CMB.2.raw
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (497)..(497): a, c, t, g, unknown or other
  misc_feature (497)..(497): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcacggccccccggaaaggccctggagtggatcgcactcacttatggaatgacgatatacgatatagtccttctctgacgacagactcacgctccacgaacgacacgtacaaaaaccgnggtcgtcctanattgaccaagtcgaccctgcgacagagcatatacttcngtcgccctacttcatcgacctanaatcgaaccncggtcttccgtaccgaacccgtggggaccagggactccgaggtccaccgtcnctaactccacgccctaaccgaaccgaacgggcccctagtcccggtcccttcccccgtcgg

SEQ ID NO: 317271 - DNA, 807 bp, Homo sapiens
  misc_feature: GZ8MTXP02JO14R.44.19.B08.1.454.CMB.2.raw
  modified_base (280)..(280): a, c, t, g, unknown or other
  misc_feature (280)..(280): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtatttaaatgtatcagcacaaacaggacagcccctaaatccngactccaggacctcgtaccctaaagtttacggaaaccgtacgggggttacccctacgtaaaggggtttccccaagggtaccggggtaaaggttcgggggttaccgttacggggggtaaccttacggggtttttttccctaccggtttccgtttaccgggttacctaacgttaaccctaaaacccgtaaaacccctttaacgaaaccggtaccccgttaagggaaaaggtaacgttacgggttacggggaacctaaaaccgtaagtttaacttttaaccgttacgggttaccctaaaccccgttaagggttaaacttacgggtaaacgttacggtttacccggtttacccccttttaaccgtaaccccggtttttacggggaccccgtaaacgggggtaaacccctaaaacgggttacggaaacgggtaaacttaaaccgaaaaccggtaaccgttagggtacgggaccttacggaaccctaaccgttaacttcggttaccgtttaccgtttacaacgttttcccccg

SEQ ID NO: 317272 - DNA, 572 bp, Homo sapiens
  misc_feature: GZ8MTXP02JR4B6.44.19.B08.1.454.CMB.2.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagngggcttgtctgggtgcggcacggccccccggaaggcccgtggagtggatcgcactcacttatggatgacgatatacgatatagtcttctctgacgaccagacctcacgctaccgacgacgacacgtaccaaaacgngtcgtacctanacttacgaccaacgtcgaccctgtcggaccacgngacactattacttctcgtcgccctagttcatcgacctanaactcgaaccgtcgggtctttccgtaccgaacccgtcggggacctaagggactcggacgtccaccgtctacgctacgacgccctaaccgaccgaacggcccctagtcccggtcccttcccccgtcgg

SEQ ID NO: 317273 - DNA, 552 bp, Homo sapiens
  misc_feature: GZ8MTXP02H4USX.44.19.B08.1.454.CMB.2.raw
  modified_base (168)..(168): a, c, t, g, unknown or other
  misc_feature (168)..(168): n is a, c, g, or t
  modified_base (316)..(316): a, c, t, g, unknown or other
  misc_feature (316)..(316): n is a, c, g, or t
  modified_base (359)..(359): a, c, t, g, unknown or other
  misc_feature (359)..(359): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccanacagaccctcacgctgacctgcaccgtctcaggcttctcactcgtcactcctggagagggcgttgtcgtgggtgcggcacgccccccggaaaggccctggagtggatcgcactcacttatggaatgacgatatacgatatagtccttntctgacgacagactcacgctccacgagacacgtaccaaaacgngtgtacctacattacgaccacgtcgaccctgtgacagacggcactattagtttcngtcgcctacttcatcgaacacaangaccgacggtcttcgttacgaccgtcgggcagggaactccgaggttccaccgtctcactacacgacccctccgaaccgaaacgggccccagtcccggttacctttcccccgcgg

SEQ ID NO: 317274 - DNA, 685 bp, Homo sapiens
  misc_feature: GZ8MTXP02H5ZSY.44.19.B08.1.454.CMB.2.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcagggtgccagatgtgacatccagatgacccagtcctccaccctccctgtctgcatccattgganacagagtcaccatcacttgccaggcgagtcagggcatacactaagttattaattggtatcancaacaaacgaggacacgaccccctaaactcctagactaccgaggtacctcgtaccctaaagtttacggaaaaccgtacggggttaccccgtagtaacgggtttcccgaagggtaccggggtaagggttcggggttaccgtacgggggttaacctttcgggtttttcctcgttccgttacgtactaacttaccaaacctaaccctacacgtcctagaagagttacggtacggacctaaactatttacttactacgtaacctaccgtaagttactacgactacggttccttacccttaaccgttaccgttacgggacccggtaagggggaaacccctaacggttagacgtaaactaccgaaaacggtacgttggacggtcctacggaaccctaccgtacgttccttacgttcctttactactttccccg

SEQ ID NO: 317275 - DNA, 709 bp, Homo sapiens
  misc_feature: GZ8MTXP02JMMJ1.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattgganacagagtcaccatcacttgccaggcagtcagggcatcaactaagtattaaattgtatcagcaacaacgaggaccacgacccctaaatcctagactaccgaggtacctcgtacctaaagtttacggaaaacgtacggggttaccctagtaaacggttcccgaagggtaccgggtaaaggtcggggttacgtaggggtaaccttggtttttacctcgttccgtcgtacaattaccaaaccgtaacctagacggtccctaggaaacgtagttggacggacctaaactatttaacgttcctagtacctaaccgaagttacgttagaaaccgttcgttaccgttacccctttaccgtaccgtttccgggaacccggtaacgggggttaaaccccaaaagggtttcgaaaacggtaaccgttaaaacccggaaaaaccgttaaacggttcgtaacgggttcctaacggaaccttaacccggtaattcccggtaagtttccttacccgtaatttcccccgg

SEQ ID NO: 317276 - DNA, 545 bp, Homo sapiens
  misc_feature: GZ8MTXP02GZMZZ.44.19.B08.1.454.CMB.2.raw
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtggggtgcggccacggccccccggaaaggccctggagtggatcgcactcacttatggaatgacgatatacgatatagtccttctctgacaccagactcacgctccacgaagacacgtaccaaaacgnggtcgtacctanattacgaccaacgtcgaccctgcggacacgaggcatattattctgtcncccattcatcgaccanaatcgaccacggtctactacgaccgtgggacagggactcgacgtcaccgtctacactacacgccctaaccgaaccgaacgggcccacgtccgtcccttcccgccgg

SEQ ID NO: 317277 - DNA, 623 bp, Homo sapiens
  misc_feature: GZ8MTXP02FONU0.44.19.B08.1.454.CMB.2.raw
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtcgcggcacggccccccggaaaggccctggagtggatcgcactcacttatggaatgacgatatacgatatacgtccttctctgacgaccagtactcacgctacacgaagacacgtacaaaacgngtcgtcctanatcgactaacgngaccctgngacagagcacgtatactttcngtcgaccctactttacacgttacgaaccctaactaacgtaccgaaccgtaccggggtactttccgttaccggaaacccggttcggggaccgaaggggtaacctccggaacgggttacccaccggtccttacaccttaccgaccggtacccctaaccgaaccgtaaccggggacccctaacgttcccggtccctttcccccggtccggg

SEQ ID NO: 317278 - DNA, 651 bp, Homo sapiens
  misc_feature: GZ8MTXP02FMH1D.44.19.B08.1.454.CMB.2.raw
  modified_base (257)..(257): a, c, t, g, unknown or other
  misc_feature (257)..(257): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattggagacagacgtcaccatcacttgccaggcgagtcgagggcatcactaagtatttaattgtatcancaacaacgaggacacgacccctaaactcctgactccagacctcgtacctaagtttaggaaaccgtacggggtacccgtacgtaaggtacccaggaccgggaaggtcggggtacgtaggggtacttacggttttcctcgttccgttccgttacactacccaaacctaaaccctacaacgtccctaaggaacgtagttaggacgacaaactattaacttactagtaccaactagtatacgtaactagttccgttaccctttacctacccgtttcgggaccgtaacggggaacctaaacggttaacggaagtaacgttaaaccgaaaaccggtaacgttacggtacggcttacggaaccacctaacgttcttacgttccttaccgactttacccccg

SEQ ID NO: 317279 - DNA, 682 bp, Homo sapiens
  misc_feature: GZ8MTXP02ISPBM.44.19.B08.1.454.CMB.2.raw
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtacgaaacccacacacgaccctcacgctgacctgcaccgtctcaggtcttctcactcgtcactccgtggagagggtcgttgtcgtgggtgcggccgaccggcccccggaaggcccgtggagtggatcgcactcacttagtaggatgacgtatatacgatatagtccttctctgacgaccagactcacgctacccgacgaacgaacacgtaaccgtaaaaaccgtacgggtacggttaccttaactacgttacgaacccgtaacggtccggtaaccctaggtacgaacgacgaggacctaactatttaacgtttctacgtaccgccctaacttcaacttcgaaacctacaaagtcggaacccgtcgggtacctttacccgtaccggtaaacccgttccgggggacgtaaacgggtaacctaccggtacgtacctcccgtactaccgtacgtacctacccggtcccaacccgaacccggaaccgggtacccctacgttccccggtaccccgtttcccccgcccggg

SEQ ID NO: 317280 - DNA, 593 bp, Homo sapiens
  misc_feature: GZ8MTXP02ITYE0.44.19.B08.1.454.CMB.2.raw
  modified_base (177)..(177): a, c, t, g, unknown or other
  misc_feature (177)..(177): n is a, c, g, or t
  modified_base (205)..(205): a, c, t, g, unknown or other
  misc_feature (205)..(205): n is a, c, g, or t
  modified_base (357)..(357): a, c, t, g, unknown or other
  misc_feature (357)..(357): n is a, c, g, or t
tcagacagtatatacacgaccggtgctcgatttagtgagtcagtaaggggactcctgtgcccaccatggacacactttgctccacgctcctgctgctgaccatcccttcatggggcctgtcccagatcaccgtgaaagagtctggccctacattggtgaaaccccacacagaccctnacgctgacctgcaccgtctcaggcttcncactcgtcactcctggagagggtcgttgtctgggtgcggcacgccccccggaaaggccctggagtggatcgcactcacttatggaatgacgatatacgatatagtccttctctgacgacagactcacgctcacgagacacgtaccaaaaccnggtcggtccttacattcgaccaagtcggacctcgtgacgacaggcacatactttctgtgacccacttactactgaccacaatacgtaaccaccggtcgttccttccgtaaacccgtcggggtaccgacgggaacgtaccgacggtacaccgtaaccgtctacgtacctaccggaccctaaccgaaccccgtaaacggggacccctaacgttcccggttccgttcccccgttcccgg

SEQ ID NO: 317281 - DNA, 596 bp, Homo sapiens
  misc_feature: GZ8MTXP02I8277.44.19.B08.1.454.CMB.2.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaaaccccacacagaccctcacgctgacctgcaccgtctcaggcttctcactcgtcactcctggagngggcgttgtctgggtncggcacggccccccggaaaggccctggagtggatcgcactcacttagttggaatgacgatatacgatatagtccttctctgacgacagactcacgcaccacgaacgacacgtaccaaaacgngggtcgaccttaanattgaacctaacggtcggaccctgtacggacacncgggacactacncttactcgtctacctactactactacaccaacacgacgtaccgacggtccgttacgttaccgtacccgtacgggtacgtaacgacgtaccgtacgtaccgtaccgtctacactaccgaccgaccctaaccgacccgaaccggaccgtaccgtcccgtcccgtcccgtccgg

SEQ ID NO: 317282 - DNA, 518 bp, Homo sapiens
  misc_feature: GZ8MTXP02F3JS3.44.19.B08.1.454.CMB.2.raw
  modified_base (358)..(358): a, c, t, g, unknown or other
  misc_feature (358)..(358): n is a, c, g, or t
tcagacagtatatacacgaccggtgctcgatttagtgagtcagtaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagcccccctgaaaggccctggagtggatcgcactcacttattggaatgacgatatacgatatagtcttctctgacgaccagactcacgcctcacgaagacacgtaccaaaaccnggtaggtccttacgattgaccaacgtgaccctgtgacacaggcacatattctgtgccacttcatgaccacaatgaccagggcttcgttcgacctggggccagggactcaggtcacgtctcactcacgcctccaccacggcccacgtcggtccttcccccg

SEQ ID NO: 317283 - DNA, 683 bp, Homo sapiens
  misc_feature: GZ8MTXP02G46J1.44.19.B08.1.454.CMB.2.raw
  modified_base (207)..(207): a, c, t, g, unknown or other
  misc_feature (207)..(207): n is a, c, g, or t
  modified_base (362)..(362): a, c, t, g, unknown or other
  misc_feature (362)..(362): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacacgaccctcacgctgacctgcaccgtctcaggcttcncactcgtcactcctggagagggcgttgtcgtgggtgcggcacggcccccggaaaggcccgtggagtggatcgcactcacttatggaatgacgatatacgatatacgtcttctctgacacagactcacgctccacgaagacacgtaccaaaaacgnggtcgtccttaacattacgaccgaacgtcgaaccctgtacgaacacgaggcaactattacttctagtcaccctacttacactacgaacccaataacgtcgaacccgtacggggtacctttaccgttacccggaaaccccggttcgggggacccgaaacgggggtaaccttacccggtaacgggttacccgtaaccccggttacgtaccctacgttacccgaacccggtaccccgttaaccccgaaaccccgggaaaaccgggggtccccctaaaccggtttcccccgggttacccccgtttacccccccggttcccggggg

SEQ ID NO: 317284 - DNA, 712 bp, Homo sapiens
  misc_feature: GZ8MTXP02IHKG8.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgaccagtcctccaccctccctgtctgcatccagttgganacagtacgtcaccatacacttgccaggcgagtcgagggcatacacttaagtattaaagtgtatcagcaacaaacgaggaccacgacccctaaatcctagactaccgagtacctcgtactaaagttacggaaacgtcgggtaccctagtaacggttccaaggtaccggtaaggtcggggtctacggggtacttacgggttttttccacgtttccgtaccgtacctaacgtaacctaaaaccctaaacccttaacgacgtacccgtaaggtaaacgtaagttaggttacggaaactaacgtaaactttaaacgttacctacgttaaaccctaaccgtaagttaacgtacgtacgttacgttaccgttacccttaactaccgtttacggaccgtaacggggtaaaccgtaacgttaaggaagtaaacgtaaactaaaaccggtaacgttacggtaacggtacctacggaaccgtaaccgtaacgttccttacggtttccctttacgtaacctttaccccg

SEQ ID NO: 317285 - DNA, 565 bp, Homo sapiens
  misc_feature: GZ8MTXP02G7ESJ.44.19.B08.1.454.CMB.2.raw
  modified_base (409)..(409): a, c, t, g, unknown or other
  misc_feature (409)..(409): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctggggtgcggcagccccccggaaaggcccctggacgtggatcgcactcacttattggaatgacgatatacgatatagtccttctctgtacgccagactcacgctcacgaggacacgtccaaaacaggtggtccttacattgaccaacgtcggaaccctgtcggacacaaggcanatattctgtcgccacttcatgacctacaatcgaaccacgggcttacgttcgaaccctggggccaggggaactccacggtcaccggtactccgatcccgagtccctaaccgacccgaaaacgggtccccgactccggttccgttccccctcccgggg

SEQ ID NO: 317286 - DNA, 662 bp, Homo sapiens
  misc_feature: GZ8MTXP02F3Y8H.44.19.B08.1.454.CMB.2.raw
  modified_base (359)..(359): a, c, t, g, unknown or other
  misc_feature (359)..(359): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctgggagagggcttgtctgggtgcggcacggccccccggaaaggccctggagtggatcgcactcacttatggaatgacgatatacgatatagtcttctctgacgaccagactcacgctccacgagacacgtaccaaaacgnggtcgtcctacattacgaccaacgtcgaccctgtaggacacgaggacaactattactttctcgtcgacccctactttacacttacgaaccctacaaacgtacggaacccgtaccggggttacctttaccgtttaccggaaaccccggttcgggggaacccgtaacgggggtaacctacccggtaacggggttacccaaacccgggttcctacgtacttacccgaaccggtcccctaacccgaaacccggaacggggtaccccctaacggttcccgggtttaccccttacccccggtcccgggg

SEQ ID NO: 317287 - DNA, 659 bp, Homo sapiens
  misc_feature: GZ8MTXP02FOY2E.44.19.B08.1.454.CMB.2.raw
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacacgaccctcacgctgacctgccaccgtctcaggcttctcactccgtcactcctgggagagggtcgttgtcgtggggtgccggcaccggaccccccggaaaggcccgtggagtggactcgcactctacttagtggatgacatatacgatatacgtccttctctacgacgaccacgtactcgacgctaccgaacgaacgaccaccgtaaccaaaaccgtggtcgtacctactattacgacctaacgtcgaccctgtacgaccacgacggcactattactttctgtccgaccctacttcactacgaacccaagtaactaccggaccgtaccgggtcctttacccggtaccggtaaccccggttcggggacccgtaaacggggtaacctacccggtacgggtaccctacccggttcctacgaacgtaccgaaccgtccccgtaacccgaacccggaccgggtcccctagttcccggtccccttccccgtccgg

SEQ ID NO: 317288 - DNA, 683 bp, Homo sapiens
  misc_feature: GZ8MTXP02F3STV.44.19.B08.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattggagacagagtccaccatcacttgccgaggcgagtcgagggcatcaataagttatttaatgtatcagcaacaacgnggacacgacccctaancctagactccgaggtacctcgtacctaaagtttacggaaaccgtggggtcccctagtaaggttcccaagggccgggtaaggttcggggtcgtacggggtacttacggttttcctcgttacgttccgtactaactaccaaaacctaaaccctagacgtacctaaggaagtagtgtacggaactaaactattaacttacgtacgtacctaaaccgtaggttaatacgtaaccgtagtttaccccgttacccttaccgttacccggtttacgggacccggtaaacgggggtaaccctaaaacggttaacggaacggtaacttaaaccgaaaaccggtagttcggtacggcttacggaacctaaccgtagtttcccgtagtttaccttccgtaccgtttccccg

SEQ ID NO: 317289 - DNA, 578 bp, Homo sapiens
  misc_feature: GZ8MTXP02IMWQR.44.19.B08.1.454.CMB.2.raw
  modified_base (366)..(366): a, c, t, g, unknown or other
  misc_feature (366)..(366): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtggagagggtcgttgtcgtgggtgcggccacggccccccggaaaggccctggagtggatcgcactcacttagtgatgacgatatacgatatagtccttctctgacgaccagacctcacgctaccacgaagacacgtacaaaaccgngtcgtctacattcgaacctacgcggaccctgtggacacgagcaactattatttctgtccgaccctacttcatacgaacccaataatcgaacccgtcgggtcctttcgttaccggaacccgtggggaccgaggtaactccgacggtccacccgtctacactccacgccctaaccgaccgaacgggcccagttcccgtcccgttccccgtccgg

SEQ ID NO: 317290 - DNA, 546 bp, Homo sapiens
  misc_feature: GZ8MTXP02GRCRB.44.19.B08.1.454.CMB.2.raw
  modified_base (178)..(178): a, c, t, g, unknown or other
  misc_feature (178)..(178): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctnacgctgacctgcaccgtctcaggcttctcactcgtcactcctggagagggcttgtctgggtgcggcacggccccccggaaaggccctggagtggatcgcactcacttattggaatgacgatatacgatatagtccttctctgacgaccagactcacgctccacgagacacgtaccaaaaccnggtgtacctacattgacctaacgtcggaccctgtggacacaggcacattattctgtcncccacttcatgaccanaatcgaccgacggtcttcgtcgaaccgtggggaccagggaactccgagtccaccgtcncactcacgccctaaccgaccgaacgggtcccacgtccggtcccttccccgtcgg

SEQ ID NO: 317291 - DNA, 560 bp, Homo sapiens
  misc_feature: GZ8MTXP02JCXM3.44.19.B08.1.454.CMB.2.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaatgtatcagcacaacnggacacgccccaaatcngactccaggctcgtactaagtttggaaacgtggggtccctagtaaggtccaggcggaagtggtctagggactggtttcactctcgtcatcaaacactcacgcctagagatgtcggactaactatattactgtaccacctagttatagactacgtcgttacccttactaccgtttcggaccgtaagggggaccctaacggtacgaacgtaactacgaaaacgtacgtacggtacggtctacggaaccgaacctaactccgttcgtacctttcgtaactttccccg

SEQ ID NO: 317292 - DNA, 552 bp, Homo sapiens
  misc_feature: GZ8MTXP02FNDD3.44.19.B08.1.454.CMB.2.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (369)..(369): a, c, t, g, unknown or other
  misc_feature (369)..(369): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccggatcaccgtgaaagagtctggccctacattggtgaaacccacacagaccctcacgctgacctgcaccgtctcaggcttctcactcgtcactcctggagagggcgttgtctgggtgcggcacgccccccggaaaggccctggagtggatcgcactcacttattggaatgacgatatacgatatagtccttntctnacgacagactcacgctcaccgaagacacgtaccaaaacaggtgtcctanattgaccaacgtgaccctgtgacacagcacatattctgtgccctacttcatcgaaccacaatcgaccgacgggccttcgttaccggacccgtggggccaaggggaactccgacggtcaccgtctcactccacgcctacccaaccgtaacggcccagtcccggttccttcccccgtggtccccg

SEQ ID NO: 317293 - DNA, 761 bp, Homo sapiens
  misc_feature: GZ8MTXP02FRV59.44.19.B08.1.454.CMB.2.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctanattggtgaaacccacacagaccctcacgctgacctgcaccgtctcaggcttcncactcgtcactcctggagagggcttgtcgtgggtgcggcacgccccccggaaaggccctggagtggatcgcactcacttatggaatgacgtatatacgatatacgtccttctctagaccgacagtacctcaccgctacccgaacgtaacgaccaccgtacccaaaaaaccgtgggttcggtacccttaacactttacgaaccctaaacggtccgggaaccccttggtacggaaaccaacgacgggactaaccgtaattaacttttccgtcggtaccgtaccccctaactttccgaaacgttccgaaaaccctaaccgtaaacgtaccggaaccccgtacccggggtacctttaccgtaaccccggtaaaaccccggtcgggggaacccgtaacggggtaacgtaccccggtaacgggtaccctaaaccccggttccgttaaccaaccgttcccgaaaccggtttccccctaacccgaaaacccccggttaaaccgggggacccccctttaaacggttccccgggtttacccccgtttacccccccgtttccgggg

SEQ ID NO: 317294 - DNA, 596 bp, Homo sapiens
  misc_feature: GZ8MTXP02G59GW.44.19.B08.1.454.CMB.2.raw
  modified_base (366)..(366): a, c, t, g, unknown or other
  misc_feature (366)..(366): n is a, c, g, or t
  modified_base (454)..(454): a, c, t, g, unknown or other
  misc_feature (454)..(454): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcacggccccccggaaggcccgtggagtggatcgcactcacttatggaatgacgatatacgatatagtccttctctgacgaccagactcacgctaccgacgaagacaccgtaccaaaaacgnggtcgtactacattacgacctaacgtcgaccctgtagacacgaggccaactattctttactgtccgtacccattaccatacgaccaanacttcgacctaccggtcttcgttaccggacccgttggggaccctaggggacctaccgacggtccaccgtctacgtactccgaccgccctaacccgaccgaaacggggtcccctaacggttcccgtccccttccccggtccgg

SEQ ID NO: 317295 - DNA, 550 bp, Homo sapiens
  misc_feature: GZ8MTXP02I58Z6.44.19.B08.1.454.CMB.2.raw
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggcccctggagtggatcgcactcacttattggaatgacgatatacgatatagtccttctctgacgaccagactcacgctcacgagacacgtaccaaaaccnggtggtccttacattcgaccaacgtcggaccctgtggacacgaggcacgattactttctgtcgacccacttcatcgacccanaatgaacccacgggcttctccgaacccgtggggaccaggggaactccgaggtcaccgtctcactcacgccctccgaccgaacggcccagtccggtccttccccgtcgg

SEQ ID NO: 317296 - DNA, 632 bp, Homo sapiens
  misc_feature: GZ8MTXP02JMA9X.44.19.B08.1.454.CMB.2.raw
  modified_base (275)..(275): a, c, t, g, unknown or other
  misc_feature (275)..(275): n is a, c, g, or t
  modified_base (453)..(453): a, c, t, g, unknown or other
  misc_feature (453)..(453): n is a, c, g, or t
tcagacagtatatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctggttctcctggacagtcgatcaccatctcctgcacgtgggtccagcaatgactagttggggatatactaaccttgtactcctggtactacaacaacntaccaaggacaaaccgacccccaaactctaatttacgttttgacgtccaagtgacggccggtccgtacgtaggttcgtttactatcccgtcttctctggctcaagtctcgccacgaccgccttcctgtcatctcgcgggtcctcggcctgacgtaggacgctaggacttagttaccgnggaccggtcttacgtaaactttaactaacccgttgtacggtaacgttcggtttcggggttcgttacgggggcgggtaagggttaccctcggtaacccgtacggtaacccgttccgtacgggtccaacgtaaccgaacggtcccgttcccggccccgttacggtacctacccgtttcccg

SEQ ID NO: 317297 - DNA, 671 bp, Homo sapiens
  misc_feature: GZ8MTXP02IVXDQ.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctcctgtctgcatccattggagacagagtcacatcacttgccaggcgagtcagggcatcaactaagtatttaaagtgtatcagacaacaaacgaggaaccacgacccctaaactcctagactaccgagtacctacgttacctaaagtttacggaaacgtacggggtcccgtagaacggttccaggacggtaaggtcggggtcgtacggggactagttttccgcttctcgtacactaccaaacaaccgtcacgtcctagaagtagtacgacgaactaactattaacttacgttacgaccaacgtaagtacgtagacccgtagttaccttacccgttaaccgtaccgtttcgggaaccgtaaccgggggaaacctaaaacgggttaggaaactaacccgaaacgtaaaaccggttaaccgttgggaccggttactacggtaacccaaaacccgttaatttcccggtaacgtttcctttaaacccggtacttttaccccccg

SEQ ID NO: 317298 - DNA, 575 bp, Homo sapiens
  misc_feature: GZ8MTXP02F6AOR.44.19.B08.1.454.CMB.2.raw
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
  modified_base (482)..(482): a, c, t, g, unknown or other
  misc_feature (482)..(482): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgccccccggaaaggcccctggagtggatcgcactcacttatggaatgacgatatacgatatagtccttctctgacgaccagactcacgctcacgaagacacgtaccaaaaaccgnggtcgtccttacattacgacctaacgtggaccctgtggaccacgaggactacatactttctcggttcncccactttcattacgaccacaatcgaccgaccgggtcttcgtacgtaacccnggggacccagggaacttccgaggttccaccggtctactactcacgccctccgaacccgaacgggccccaagtccggtccctccccgttccggg

SEQ ID NO: 317299 - DNA, 642 bp, Homo sapiens
  misc_feature: GZ8MTXP02FV1IR.44.19.B08.1.454.CMB.2.raw
  modified_base (366)..(366): a, c, t, g, unknown or other
  misc_feature (366)..(366): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtcgtgggtgcggcacggccccccggaaacggccctggagtggatcgcactcacttatggaatgacgatatacgatatagtccttctctgacgacagactcacgctccacgaagacaccgtaaccaaaaaccgnggtcgtacctacattcgacccaacgtcggaccctgtcggaacacgaggcaactatactttctagtcgaccctacttacactacgaacccaactaacgtacgacccgtaaccgggtcctttacccgttaacccggtaaccccgggttcgggggacccgtaaacgggggtaaccttacccggacgggttaccctacccggttaccttaccacgttaccgacgcccctaacccgaacccgaaccgggtcccacggttcccgtcccttcccccggtccgg

SEQ ID NO: 317300 - DNA, 685 bp, Homo sapiens
  misc_feature: GZ8MTXP02JQOSW.44.19.B08.1.454.CMB.2.raw
  modified_base (211)..(211): a, c, t, g, unknown or other
  misc_feature (211)..(211): n is a, c, g, or t
  modified_base (595)..(595): a, c, t, g, unknown or other
  misc_feature (595)..(595): n is a, c, g, or t
  modified_base (630)..(630): a, c, t, g, unknown or other
  misc_feature (630)..(630): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtacgaaacccacacacgaccctcacgctgacctgccaccgtctcaggtcttcncactcgtcactccgtggagtacgggtcgttggtcgtggggtcgccgggacgaaccgggacccccccggaaaggcccgttaggacggtggagtccgactactctaacgttagtggaaatcgaacgtaatacgtacgtaatagtacgttccttacgtccgtacgtaccgtaaccgacgtaccgtaccggccgacgtacccgaacgtaaacggacctaaaccggttaaccaaaaaccggttcggttacggttacccttaacgtacgttaccgaaccgtaacggttcgaacccgttgtacggaccacgtacgactaactattcgttactgtccaccgtacttcacgtacaccgatagtacgaccgtcggtccttaccgcggtaaccgnggggtacccaaggtacctccgacggtccaccgttnaccgtcaccgtctccctaaccgaccgtacggactccgtccgtaccctccggtccg

SEQ ID NO: 317301 - DNA, 738 bp, Homo sapiens
  misc_feature: GZ8MTXP02JEYEW.44.19.B08.1.454.CMB.2.raw
  modified_base (153)..(153): a, c, t, g, unknown or other
  misc_feature (153)..(153): n is a, c, g, or t
  modified_base (392)..(392): a, c, t, g, unknown or other
  misc_feature (392)..(392): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctanattggtagaaaccccacacagaccctcacgctgacctgccaccgtctcaggcttctcactcgtcactccgtggagagggtcgttgcgtgggtcgcggccgacggccccccggaaggccctggagtggatcgcactcacttatggaatgacatatacgatatacgttccttctctacgacgaccacgtacctcaccgcctaccgaaccgtaaggacctaaccgtaaccccaaaaacccgngggttcgggtaccctttaacgagtttaccgaaccgtaaaccggtcggtacccttcggtacggaaccaacgacgggacctaacgtatttactttacctggtaccgacccctacttacctagttaccgaacccttaacaacgttacggaaacccccgtacgggttaccctttaccgtaaccccggtaaaccccgggttccgggggaacccgaacggggttaactacccggtaacgggtacctaccccggttcaccctacgtacccgaaccacccccgttaaccgaaccccgaaccgggggtaccccctaaggttacccccggttaccccgttcccccgttacccgggg

SEQ ID NO: 317302 - DNA, 670 bp, Homo sapiens
  misc_feature: GZ8MTXP02HUK9O.44.19.B08.1.454.CMB.2.raw
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgccaccgtctcaggcttctcactcgtcactcctggagagggcgttgtcgtgggtgcggcacggccccccggaaaggcccgtggagtggatcgcactcacttatggaatgacgatatacgatatagtccttctctgacgaccagactcacgcctaccaacgaacgacacgtaaccaaaaaccgaggtcggtaccttaacacgttacgaaccaacgtacggaccctgtacgaccacgacggacaacgtattaacttttcgtcgtaccgccctactttaccaattcgaaccctaaactaaagttaccggaacccgtacgggtcctttaccgttaccggtaaaccccggttcgggggaacccgaagggtaaccgttcccgaacgggttaccacccggttacttccgaactaccgaacgtcccctaacccgaaacccggaacggggtaccccaacggttcccgggtttccccttcccccggtccggg

SEQ ID NO: 317303 - DNA, 764 bp, Homo sapiens
  misc_feature: GZ8MTXP02HBSVE.44.19.B08.1.454.CMB.2.raw
  modified_base (213)..(213): a, c, t, g, unknown or other
  misc_feature (213)..(213): n is a, c, g, or t
  modified_base (283)..(283): a, c, t, g, unknown or other
  misc_feature (283)..(283): n is a, c, g, or t
  modified_base (344)..(344): a, c, t, g, unknown or other
  misc_feature (344)..(344): n is a, c, g, or t
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtacgaaacccacacacgaccctcacgctgacctgccaccgtctcgaggtccttcncactcgtcactccgtgggagagggtcttgtcgtgggtgcggccgaccggccccccggaaaggcccgtggngtcggatcgcactcacttagtacggtaatcgacgatataacggtatactacgtccttcctntacgtacgacctagacctacgccgtactacccgaacggaacggaacctaacccggtaacccgtaaaaaaccggtcgggttaccggttaccctttaaaaccgtacgttacccggaaacccgtaacggttaccgggtaacccccgttagggtacggaaacccgtacgacggggtaacctaaccgtaaacgtttactttaccgtaccgggttaccgtacccccgttaccttaaccgtaactttaaccggaaaccctaaacgtaacgtaccggaaacccgtaccggttaccctttacccggtaccggtaaacccgggtcgggtaccggtaaacggtaccgtaccgacgggtacctaccgtctacgtactccgacgtccctaaccgaccgaaccggtccaccgtccggtaccctccccggtccgg

SEQ ID NO: 317304 - DNA, 745 bp, Homo sapiens
  misc_feature: GZ8MTXP02F1FNG.44.19.B08.1.454.CMB.2.raw
tcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtacgaaacccacacagaccctcacgctgacctgcaccgtctcaggcttctcactcgtcactcctggagagggtcgttgtcgtgggtcgcggcaccggtcccccggaaaggcccgtggagtggactcgacactctacttagtgaatgacgatatacgtatatacgttccttctcgtacgacgacacgacctcacgctacccgaacgaacgaacctaaccgtaaacccaaaaaccggtgggttaccggttacccttaacgtaacgttaccggaaaccctaacgggtccggtaacccgttagggtacgaaaccgaccgtaacgggtacctaacgttaaacttccgtttttaacgccggttacctaacccccgttactttaaccggaacttacccggaacccttaaacgaaaccgttacccgggaacccgtaaccggtcctttaaccggtacccgggtaaacccggttcggggaaaccgtacggaaactccggacggtaccctaaccggtctacgactaccggaccctacccgtaacccgaaccggtaaaccggccctaacggttccccgttccccgtaccccggttccgg

SEQ ID NO: 317305 - DNA, 679 bp, Homo sapiens
  misc_feature: GZ8MTXP02IS22Q.44.19.B08.1.454.CMB.2.raw
  modified_base (195)..(195): a, c, t, g, unknown or other
  misc_feature (195)..(195): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtcctccaccctccctgtctgcatccattgganacagatccaccatcacttgcaggcgagtcaggcatcacttaagtattaagttgtactcagcaacaacgaggacacgacccctaaactcctagactaccaggtacctccgtaccctaagtttacggaaaccgtacggggtccccgtaggtaacggtttaccgaggtccggtaaggttcggggtacgttacggggtaacttcgggtttttcctcgttccgttacgtacctaacgtacctaaacctaacccgtacgacgtacccgtagtaacgtacgtgtacggactaacgtacttagttaccttacgtacctaaccgtaagttaacgtcgtacgtaccgttaccgttacccgtttaccgtacccgttcgggtacccgtaacgggggacccttaaacggtacgacgtaaacgtaaccgtaaaacgaacgttcgggtacgcttacggaaccgacttacttcggtctttaccgtttaccactttccccg

SEQ ID NO: 317306 - DNA, 675 bp, Homo sapiens
  misc_feature: GZ8MTXP02IH40M.44.19.B08.1.454.CMB.2.raw
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatgacccagtctcccaccctccctgtctgcatccattggagacagctcaccatcacttgccaggcgagtcgagggcaatcaacttaagttaatttaattggtactcagaccaacaaaccgaggaccacgacccctaaactcctagactccaggtaccctacgtaccctaagtttacggaaaccgacggggtacccctacgtaacggttcccgaaggtccgggaaaggttcggggtacgtacggggtacttacgggtttttccacttcgttcgtactaacgtaccaaacgtaaccctacgacgtccctaagacgtagtcgtacgacaagttatacttactagttaccaccgtaagtacgtacgacgtacggttaccttaccccgtttaacgtccctttacgggaccggtaaacggggaaccctaaacggttaacggaaacgtactaaaccgtaaaacggtaacttcggacggtcttagaaccctaccgtacttcgtacgtttcttaccctaactttcccccg

SEQ ID NO: 317307 - DNA, 604 bp, Homo sapiens
  misc_feature: GZ8MTXP02GKM6Q.44.19.B08.1.454.CMB.2.raw
  modified_base (468)..(468): a, c, t, g, unknown or other
  misc_feature (468)..(468): n is a, c, g, or t
tcagacagtatatacacgaccggtgctcgatttagtgagtcagtaagggggcaggagtcagtcccaaccaggacacagcatggacatgagggtccctgctcagctcctggggctcctgctgctctggctctcaggtgccagatgtgacatccagatcgacccagtcctcccaccctccctgtctgcatccattggagacagactcaccatcacttgccaggccagtcgaggcatcacttaagttattaatgtatcagacaacaacgacggaacacgacccctaaactctgactccagacctcgtactaagtttacggaacgtacggggtccctagtacgtccgagtcggtaagtgggtacgtggtaacgttgttttcctcgttctacgtctaacgtaccaaacgtaacctacgtacgcctaagaagtagttggcgaacaacgtatacttacgagacctacgtagttanacgactagtaccttaccctacgtcgttacgggcgtaaacgggtaccgaacgtaacgtaacgtaactaacgaaaactaacgttgggacgcctacgaacctacgtacttacgtcgtttactccgttacctttaccccg

SEQ ID NO: 317308 - DNA, 642 bp, Homo sapiens
  misc_feature: GZ8MTXP01B00DG.10.48.E04.1.454.CMB.2.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgcctccgaggggaagacnccacctctcctgcagggccagtcagagtgtagcatctacttgcctggtccanagaacctgccaggctccgagcctctcatctataatgactactacccaaacgcgggcccaacgtggaccactccccgaagccaggtttcccaggttggcgtagggtggggtacgtaggggccaggtacctttcaccgtctacaccatacacgacgacgacctaggacgtaccgtagtaacgttattttacgacttaagttttaacttacgttacggttacgtacgtctacggttccgtttccgtcccgttcggtcccttacgtaccgttacgttttcgggacccggtaacggggtaacccgttaaggtccgttagggacgtaacttccgttagttacggaacggtaacgtcggttcggtcgttccggtaaccgttaaccttaaccg

SEQ ID NO: 317309 - DNA, 707 bp, Homo sapiens
  misc_feature: GZ8MTXP01DVW10.10.48.E04.1.454.CMB.2.raw
  modified_base (291)..(291): a, c, t, g, unknown or other
  misc_feature (291)..(291): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgtctccgaggggaagacgccacctctcctgcagggccagtcagagtgttagcatctacttagcctggttccaacagaaacctggccaggcctcccaggctcctnatctaataatgacactaccaaacgacgggcccaacgttggaccacttcccccgaaggccccgtagggtttccccaagggttcggaccgtaagggttcgggggtccttagggggaacctaaggtacccttttaccaacctttccaccaaccctaacttccaaggccaacgacccttaaggaacgtacccgttagtaaagttagtttttcggaccttaaggtttttaactttaaccgttgggttacgtacggtccgtaacggttccgttttccgcccgttcgggtcccttctaaccgttaccgttttcgggcccgggtaaacgggggaacccttaaagggtcccggttagggaaggtacttaccgttagttacggtaaccgtaacgttggtcgggtccttcggcccgttaaccgttcg

SEQ ID NO: 317310 - DNA, 633 bp, Homo sapiens
  misc_feature: GZ8MTXP01BKI23.10.48.E04.1.454.CMB.2.raw
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaagacgccaccctctcctgcagggccagtcagagtgttagctatctacttagcctggttaccaacagaaacctggaccaggcctcccgaggcctcctcatctaataatcgacactacccaaacgtacggggccctaacgtcggaccactcccccaggccctaagggtttcccaggttcgggcgtaggggttcggggtaccgtggggaactaggtacctttcaccttcctacacctatcacgcacgacctagacgtacctaggtaacgttattttgacttaagttttattacgtggttactagtctacggtccgtttccgccgttcggtccctctaccgttacgttttcgggcccggtaacggggaacccaaggtccgttagggacgtattcgagttcggaacgtacgtggtcggtcttcgcttaaccgtaac

SEQ ID NO: 317311 - DNA, 587 bp, Homo sapiens
  misc_feature: GZ8MTXP01ANYJB.10.48.E04.1.454.CMB.2.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcagggccagtcagagtgttagcatctacttagcctggtccaacagaaacctggccaggcctcccaggcctcctnatctataatgcatccaacacgggcccacgtggcactccccgagcccgtaggttcccaggtggcgtaggtggtcngggcagacttcactctcaccatcagcagcctagacgctagaagtctttgacttaagtttacttacgtggttcacggtctacggttccgtttccgccgttcggtcccttcgtaccttaccggttttcgggacccggtaacgggggtaaccaagggtccgttagggaagtacttcgagttcggtaacgtaacgtgggtgggtccttacggtccgaaccgtaag

SEQ ID NO: 317312 - DNA, 669 bp, Homo sapiens
  misc_feature: GZ8MTXP01EV7BH.10.48.E04.1.454.CMB.2.raw
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (319)..(320): a, c, t, g, unknown or other
  misc_feature (319)..(320): n is a, c, g, or t
  modified_base (425)..(425): a, c, t, g, unknown or other
  misc_feature (425)..(425): n is a, c, g, or t
  modified_base (518)..(518): a, c, t, g, unknown or other
  misc_feature (518)..(518): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctacctctggctcccagataccaccggagaaattgtgttgacacagtctccagccacctgtactttgcgtaccgaggggaacgacgccccaccctctcctcgcgagggccagtcagtagtgtagtctacttactaccttacggtcctacgtacaaaccaggaacctggccncgcgccacgctctctatactanacnncaactcgaccaacgggtccgacctagcccacgtccccacggtccagggttcggacgtaggtcggtacggttgggggtccgtagggtacgtacgaccttactactntacccaacctactaccgacgacgaccgtacccgaacgtaccgttaccggtaaacgggtaaacgttttaacggtttacgtacgtttaacggttnttaaacttacgttcgtacgtacgtacgtacgttcggttccgtccgtccggtccgtcctaccgtttacggttcggaccgggaccgggtcaaaccgggttaacgttcgggtaacgggacgtaacgaactaggttacgtaacggttaacgtcgg

SEQ ID NO: 317313 - DNA, 508 bp, Homo sapiens
  misc_feature: GZ8MTXP02GDNK0.10.48.E04.1.454.CMB.2.raw
  modified_base (260)..(260): a, c, t, g, unknown or other
  misc_feature (260)..(260): n is a, c, g, or t
  modified_base (413)..(413): a, c, t, g, unknown or other
  misc_feature (413)..(413): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgctccaggggaagagccaccctctcctgcagggccagtcagagtgttagcatctacttagcctggttccaanagaaacctggccaggctcccaggctcctcatctataatgcatccaacagggccacgtggcactcccagccaggttccagtgcagtggctgggcagacttcactctcaccatcagcagcctagacgctagaagtatttgactagtttattactntctagctacgtcgttcgtccgtcggtctctactacgtttcgtcgacgggacgacgacgtagacgagtacatgaacgacgtcgtgcgtcgcactac

SEQ ID NO: 317314 - DNA, 524 bp, Homo sapiens
  misc_feature: GZ8MTXP02GV4WE.10.48.E04.1.454.CMB.2.raw
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagagtgttagcatctacttagcctggttccaacagaaacctggccaggctcccaggctcctcatctataatgcatccaaacagggccacgtggcactcccagccaggttcccagtgcaggtgggtctgggcagacttcactctcaccatcagcagcctagagcctgaagtatttgctagtttatactgtcagcagtcgttcgcctcggcctcgtactacgtttcggaccgtacggggacccaaagccgtaggaacgtagtcgaagtcgaacgtaacgtggtcggctcgaccactac

SEQ ID NO: 317315 - DNA, 550 bp, Homo sapiens
  misc_feature: GZ8MTXP02H0UT9.10.48.E04.1.454.CMB.2.raw
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccagggggaagagccaccctctcctgcagggccagtcagagtgttagcatctacttagccttggtccaacagaaacctggccaggcctcccaggcctcctcatctataaatgacataccaaacgaggggcccactggcatccccagcccaggttcccaggtggcaggttcgggtctggggacagtacttcacttcacacctatcagcacgcctagacgactagaagtatttgactagtttattactgtcagcagtcgtttcgccgtcggtcctcactacgtttcggaccgtacggggaccaagcgtagggaacgtacgtacgagtacgaacgtacgtcggtcgcgtcgacctactacg

SEQ ID NO: 317316 - DNA, 500 bp, Homo sapiens
  misc_feature: GZ8MTXP02JYV31.10.48.E04.1.454.CMB.2.raw
  modified_base (212)..(212): a, c, t, g, unknown or other
  misc_feature (212)..(212): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctntcctgcagggccagtcagagtgttagcatctacttagcctggttccaacagaaacctggccaggctcccaggctcctcatctataatgcatccaacagggccactggcatcccagccaggttccagtgcagtgggtctgggcagacttcactctcaccatcagcagcctagacgcctgaagtatttgctagtttattactgtcagcagtcgttcgcctggcctcactactttcgccgtacggggaccaaggctaggagactcagtgcgaactggtcggctcgcactac

SEQ ID NO: 317317 - DNA, 649 bp, Homo sapiens
  misc_feature: GZ8MTXP02FXERI.10.48.E04.1.454.CMB.2.raw
  modified_base (262)..(262): a, c, t, g, unknown or other
  misc_feature (262)..(262): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagtgtgtagctatctatacgcctggttacccaanaacgaaacctcggaccaggccctacccgaggtccctcctacattactaataatcgactactacccgaaacgcgggcccacgtcggacctacctccccgagtacccgtaggttcccagggtcgacgtagggttcgggtcgtaggggacacgtaccttccgaccttcctaccacctataccgagaccacgtacccgtaaggaccgtcccgtaggtaaagttacgttttcgaccgttaagtttttacttacgttcggttacacgtcgtacggttccgtttccgccgtcggtcctaccgtactttacgtttcgggacccgaacgggggtacccaaggtccgtaggacgtactacgagtcgaacgtaactggtcggtctcggacctacgtac

SEQ ID NO: 317318 - DNA, 514 bp, Homo sapiens
  misc_feature: GZ8MTXP02HGWGI.10.48.E04.1.454.CMB.2.raw
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagagtgttagcatctacttagcctggttccaacagaaacctggccaggctcccaggctcctcatctataatgcatccaacagggccactggcatcccagccaggttccagtgcagtggtctggggacagacttcactctcaccatcagcagcctagacgcctgaagtattttgactagtttattacttgtctagctagtcgtttcgccttggcctcactacgttttggccgtaggggaccaagcgtggacgcgtcatgaacgtaactggtaggctcggacactacg

SEQ ID NO: 317319 - DNA, 575 bp, Homo sapiens
  misc_feature: GZ8MTXP02I5OGI.10.48.E04.1.454.CMB.2.raw
  modified_base (306)..(306): a, c, t, g, unknown or other
  misc_feature (306)..(306): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgctcaggggagagccacctctcctgcagggccagtcagagtgttagcatctactagcctggttaccaacagaacctggccaggcctcccgaggctcctcatctataatgcatccaacgngggccacgtggcactcccagccaggttccagtggcaggtgggtctgggacagacttcacctcctacacccatacagcagcctagacgcctagaagtatttacgactagtttattactgtacagtctaggtccgtttccgccgtcggtcctacgtaccttacgttttcgggacccgtaacgggggtacccaaacggtccgtaggggtaacgtacgttaccgagttcggaacgtaaacgttcggtacgggtctacggtacccaccgttacg

SEQ ID NO: 317320 - DNA, 614 bp, Homo sapiens
  misc_feature: GZ8MTXP02FJ8FB.10.48.E04.1.454.CMB.2.raw
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcagggccagtcagagtgttagcatctactagcctggttccaacagaaacctggccaggctcccaggctcctnatctatatgcatccaacncgggccactggcatccccagccagggttcccaggtcggctaggtggggtctggggacagacttcactctcaccatcagcacgcctagacgtcccgtagtaaacgtattttcgacttaaggttttaacttacgttagttccgaggtccgtacgggttccgtttcccggccgttcgggtcccttaccgtacccgttaccgttttcggggacccggtaacgggggtaccctaaacgggtcgttacgggaacgtacgtacctaagtcggaacgtaaacgttcggtacgggccgttcggaccgtacctacg

SEQ ID NO: 317321 - DNA, 493 bp, Homo sapiens
  misc_feature: GZ8MTXP02FE68W.10.48.E04.1.454.CMB.2.raw
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccagggaagagccaccctctcctgcagggccagtcagagtgttagcatctacttagcctggttccaacagaaacctggccaggctcccaggctcctcatctataatgcatccaacngggccactggcatcccagccaggtccagtgcagtgggtctgggcagacttnactctcaccatcagcagcctagagcctgaagatttgctagtttattactgtcagctagtcgttcgcctggcctcactactttcgccgtacggggaccaagcgtggagactcatgcgaactgtcggctcgcacac

SEQ ID NO: 317322 - DNA, 639 bp, Homo sapiens
  misc_feature: GZ8MTXP02JNNIZ.10.48.E04.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (398)..(398): a, c, t, g, unknown or other
  misc_feature (398)..(398): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgtctccgaggggaagagccacctctcctgcagggccagtcagagtgttagcatctacttagccttggttaccaacagaaacctggaccaggcctcccgaggcctcctnactctaataatgcatcccaacgngggccacgtcggacactcccagtccgaggttccaggtcggctagggtcgggtcgtggggactagtacctttcaccttacnccacctatccgaagtacccagtacccgtagacgtaccctaggaaacgttagttttcgaacttacgtttttaatacgttgtacgtacgtctacgggttaccgtttccgaccgttcggaccttactaccgttaacgtttcgggacccggtaacgggggaacctaacgggtccgtaggggaactacgttaccgtaagttacggaaccggtaaacgtcggtaggttccacggtacctaaccctag

SEQ ID NO: 317323 - DNA, 639 bp, Homo sapiens
  misc_feature: GZ8MTXP02GJMFF.10.48.E04.1.454.CMB.2.raw
  modified_base (260)..(260): a, c, t, g, unknown or other
  misc_feature (260)..(260): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccacctctcctgcagggccagtcagagtgttagcatctacttagcctggtccaanagaacctggccaggcctcccgaggcctcctcatctaataatcgacactccaacgacgggcccacgtggaccacgtccccagcccgtaggttcccaggtcggcaggtcgggtctggggactagtacttccacgtcctacacctatcacgacacgtacctagacgtccgtagtaacgtagttttcgacgttaagtttaacttacgttacggtacgtacggtaccgtacggttccgtttcccggtccgttaccgggtcccttaccgtacccgtttaccggtttttccgggacccggttaacgggggaacccgtaaacggtccggtaggtacgtacgtacgtacgttagaaccgtaacgtggtcggtctacgaccgtactacg

SEQ ID NO: 317324 - DNA, 605 bp, Homo sapiens
  misc_feature: GZ8MTXP02IJTW2.10.48.E04.1.454.CMB.2.raw
  modified_base (400)..(400): a, c, t, g, unknown or other
  misc_feature (400)..(400): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctccagataccaccggagaaattgtgttgacacagtctccagccacctgtctttgtctccaggggaagagccacctctcctgcagggccagtcagagtgttagcatctacttagcctggttccaacagaaacctggccaggcctcccaggcctcctcatcctaataatcgacatacccaaacgacgggcccagtggaccactccccaagccctaggtttcccaggtcggctaggtgggtctggggacctgacttcactcctcacctancagacacgactagacgtacgtagtaagttagtttacgtacgttaagtttacttacgttgtacgtagtcgtacgttccgtttccgtccgtacgtcctacgtacgttacgtttacggaccggtacgggtaaccgtaacggtcgtacggtaacgtacgtacgtaagtacgtaacgtaacgtcggtcggtacgtcgtaccgtacgtacg

SEQ ID NO: 317325 - DNA, 736 bp, Homo sapiens
  misc_feature: GZ8MTXP02FZFPF.10.48.E04.1.454.CMB.2.raw
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgctccgaggggagagccacctctcctgcagggccagtcagagttgttagctatctacttagctggttaccaanagaaacctggccaggcctcccaggctccncatctatatgcactaccaacgaggcccacgtcggctaactccccaagtcccgaggttcccaggttcgggactaggggtcggggtaccgttacggggacctaaggtacccttttaccgaacccgttccttaccaaacccgtattacccgaacggtacccgaacggtaccccttaaggaaccggtacccgttaacggttaaaagtttacgtttttacggtaccgtttaaggtttttaaactttacgttacgttacgaccgttacgtaccgggtttccggttttacccgtcccgttacgggtccccttaccgttaaccgttaacccggtttttcggggacccgggaaaaccgggggtaacccgtaaacggtaccggttaagggaacgttacgtacgtaacgttcggaacgttaaacggttggttacggtctacggaccgtaacgttaccg

SEQ ID NO: 317326 - DNA, 537 bp, Homo sapiens
  misc_feature: GZ8MTXP02G7PO8.10.48.E04.1.454.CMB.2.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccacctgtctttgctccaggggaagngccacctctcctgcagggccagtcagagtgttancatctacttagcctggttccaacagaaacctggccaggctcccaggctcctcatctataatgcatccaancgggccacgtggcactccagccaggttccagtgcagtgggtctgggacngacttcgactctcaccatcagcacgcctagacgctagaagtntttagactagtttatactgtacagctagtcgtttcgaccgtggtcctactacgtacgtttcggacccgtaacggggacctaaagtccgtaggacgtacgtccgaagtcgaacgtaacgtggtcggactcggcctaactacg

SEQ ID NO: 317327 - DNA, 661 bp, Homo sapiens
  misc_feature: GZ8MTXP02HMNX8.10.48.E04.1.454.CMB.2.raw
tcagcatagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagcccacctgtctttgcctcgaggggaagagccacctctcctgcagggccagtcagagtgttagcatctacttagcctggtaccaacagaaacctggaccaggcctcccgaggcctcctcacttctaataatgactactacccaaacgacgggccacgtcggaccactccccgagtcccgtaggttcccaggtcggctagggttgggtctaggggacctacgtacctttccaccttcgtacccaacctataccgacgacctaacgacccgtaaggacgtacccgttaggtaacgttacgtttttacgacttaaggtttttacttaacgtttcgtacgtaacgtcgtacgggtttccgtttccggtccgttcgggtcccttcgtaccgttaccgtttcgggaccggtaacgggggacctaacggtccgtaggaacgtacgttacgacgtacgaaccgtaagtcggtcggccttacggacctacttaccg

SEQ ID NO: 317328 - DNA, 577 bp, Homo sapiens
  misc_feature: GZ8MTXP02IO95S.10.48.E04.1.454.CMB.2.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
tcagcatagtagtgcacgaccggtgctcgatttagagagcgtcacagagagaagggggaggaactgctcagttaggacccagagggaaccatggaagccccagctcagcttctcttcctcctgctactctggctcccagataccacggagaaattgtgttgacacagtctccagccacctgtctttgctccgaggggaagngccaccctctcctgcagggccagtcagagtgttancatctacttagcctgtcaacagaacngcagctcccagctctnatctataatgcatcccaaanagggccaagtggacactcccagcccaggttccagtgcagtgggtcngggcagtacttccaacgtcctcaaccgatacacgacacgacctagacgccgtagaaagttaagttttgactaagttttaattaccttagttaccgagctacggtccgtttcggccctcgggtccctacaccgttacttttcgggacccgtaagggggacccaaaaggtcctagggaacgacttacgaacgtacgtaacgtaacgtacggtacggtcgtacgaccgtacgtacg

SEQ ID NO: 317329 - DNA, 563 bp, Homo sapiens
  misc_feature: GZ8MTXP01AVNSJ.41.86.H09.1.454.CMB.2.raw
  modified_base (308)..(308): a, c, t, g, unknown or other
  misc_feature (308)..(308): n is a, c, g, or t
tcagtctatactatcacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcacgtgggtcccncaggctccaggcaagggactgggaggtgggtggctacttatagtggtatgataggaaaagttaataagtattagtagtaacgtatttcccggtagaaacggggccgtattccaccatctccaagagacaattcgaaagaacacaactaatactactagaaattagaaatgacctagagagccgaaggcaacggcttggtaccttacgtacgtgttgcgagaagagtggggactcgggttagtaagttaacgaagg

SEQ ID NO: 317330 - DNA, 592 bp, Homo sapiens
  misc_feature: GZ8MTXP01CNYGA.41.86.H09.1.454.CMB.2.raw
  modified_base (356)..(356): a, c, t, g, unknown or other
  misc_feature (356)..(356): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggattccatcagttctgatctattcgttggggctggactccggcacgccccgagggagggagtggagtggagtggtagactatacctattagtacgtggggcgtacgtactactctccgtccccctacagngtcgtctcacctgttcgagggctacgtccatcgaaccgtcttctccctagaaactcgaccctcgtcgacccgccgacgactacggtccgtttattcggtgtggccgtaggcgtagtcgttggttctttacgtactcgtacggtcggggtccgtcggccgtaccgttgggtcctacgttcgttccttcctcgacgtcccttcccgaccgttaaccgggtcccttaacgtttccccgg

SEQ ID NO: 317331 - DNA, 567 bp, Homo sapiens
  misc_feature: GZ8MTXP01EFKDK.41.86.H09.1.454.CMB.2.raw
  modified_base (369)..(369): a, c, t, g, unknown or other
  misc_feature (369)..(369): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgcccccgaggggagggaagtggagtggagttggtgacatccattatacgtgggcgacgtactactctccgtccccctacaagagtcgtctacacctntttcgaggacacgtcatcgaaccgcttctcctagaaactcgacctccgtcgaccgccgcgacacggtccgtttattcgtgtgcgaggcgagactggttctttcgaatctagtcggggcgttggcctacccgttggtctacgttgttccttccgtctacgccctttcccgaccttaacggggtccccaagtttccccgg

SEQ ID NO: 317332 - DNA, 533 bp, Homo sapiens
  misc_feature: GZ8MTXP01BG7AZ.41.86.H09.1.454.CMB.2.raw
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
tcagtctatactatcacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtggggtcccnccaggctccgaggcaaggggactgggagtgggtgcacttatatggtatgatggaaaataataatattatgtagattcggngaagggccgattcacatctcagagacaatcgaanaacacactatatctaggaaatagaatagcctaggagaggacccggaggacgaacggcttggtcttacgtactgttgcgagaagagtggggctcggttaggaattaacgaag

SEQ ID NO: 317333 - DNA, 605 bp, Homo sapiens
  misc_feature: GZ8MTXP01EZLAO.41.86.H09.1.454.CMB.2.raw
  modified_base (379)..(379): a, c, t, g, unknown or other
  misc_feature (379)..(379): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacggcccccgaggggacggggaagtggaggtgggtagtttggtgactatcctattatacgtggggcgacgtactactctccgtcccctcaagacgtcgtctacacctntttcgagggacacgtccatcgaaccgtcttctaccctagaactcgacccttccgtcgacccgccgcggacacggtccgtttattcgtgtcgcgtaggcgagacgttggttctttacgaaacttcgtacggtcgggggtcccgtgggttcccacccgttgggtccacttcggttccttcccctcacgtccttcccgaccgttaacgggccccttaagttcccccggg

SEQ ID NO: 317334 - DNA, 640 bp, Homo sapiens
  misc_feature: GZ8MTXP01B9XX5.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctctggtacgtttcatctagttctgatctattcgttgggctggactccggcacgccccgagggagggagtggtaggtggtagttggtgactactacctaagtttagtacgttgggggacgtacgttaacttacgtcctccgtacccccctacaacgtagtccgtcctactaacctgttacggaaggtacctacgtcctacgtacgaaccgtcttacctccgtagaaactcgtacccgtccgtacggacccgtccgcggtaccaccggtacctttacgtttcggtcgtcggccgaggcgacgttacgtggtttacttactaaagttcgtaaggtcggggtccgtaggcctacccgttggtcctacgttcgttccttctctagtccttcccgacgaccggtcccttaacgtttccccgg

SEQ ID NO: 317335 - DNA, 583 bp, Homo sapiens
  misc_feature: GZ8MTXP01EOC9Z.41.86.H09.1.454.CMB.2.raw
  modified_base (293)..(294): a, c, t, g, unknown or other
  misc_feature (293)..(294): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
tcagtctatactatcacgaccggtgctcgatttagtgctatagacttgggtttggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcacagtgtctatttcccatggctccaacagaagcctgccaacgccccagacactaattannatatactatagacngtctgacacngccntcncncgcctcctcgtgggacaaacgcccncctcgtacccttcgagtcgcgcacgtcctgaggatggagctagtacttattactgtcttcgtcttcttaccgttagttaggtttagtttagtccggtagttcggttccgggacgggacggaccgaacgtccgtacggtaaccggttccgttaggtccgacgcccgtaacgggccttccggcccccgttgtccctaaccttccgttcccgttacccctcccgttccgttaac

SEQ ID NO: 317336 - DNA, 746 bp, Homo sapiens
  misc_feature: GZ8MTXP01BQ0VD.41.86.H09.1.454.CMB.2.raw
tcagtctatactatcacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggaggcgtggtccagccgtgggacgtccctgagctctcctgtgtagcgtctggattcaccttcaaacagacagtggcagtgcacgtcgggtccccgccgaggcctaccggaggacgaaaggggcgtgggaggtgggggtgactactttagtagtggtatgtaagttagggtaaaaaattaattaagttatttagtaggttagtacgtttccgggagggaaacggggtcccgtaatttcccgaacctagttacccgtaccgtaaagggtaacgtaaacctaaacgtttaaccgaaaaacgtaaactaaactttaaccgttaaagttaaacgtttaccggttaaaggtaaaaacgttaggtaaaacgttacggtaacccgttaaggggaacgtaaccggggacccgggaaacggggaacccgtaaaccggggtcttacgggttaacccgttaacgttacggttggttacgggaccggaagggaaggtacgggtcgggggtacctcggggttaggtaacttaacggtaagg

SEQ ID NO: 317337 - DNA, 814 bp, Homo sapiens
  misc_feature: GZ8MTXP01EH453.41.86.H09.1.454.CMB.2.raw
tcagtctatactatcacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgctactgtctcgtggtactttccattcgtagttctagtactctagttcgttgggggctggacgtcccggcgaccggacccccggaggggacggggtaagtgggtaggtggtagttggtgactatactattagtacgtgggtacgtacgttactacttccgtcccgtaccccctacgtaacgtacgttccttcccgtaacctacccgttaacgtttccgggaaacggggtaaccctaacccggtcctaacggttacgtaaaccccgttcctttacccttaccccgttaacggtaaaaccttccggtaaccccgttacccgggttaccggaccccgggtacccgggtaccgggttaacccggtacccgggtttaccgtttttttaaacggtttccggggttacggggttaccgggtacgggtaacggggtaccggttaacgggttaaccgtttccgggtttaccttttaacgtaaacgtttcggttaacgggtcgggggtaaccgtcgggcccttaaccggttggtacctacgtttcggttccttccctaacgccgttccttacccgaccgttaaccggtcccgttaacgtttccccggg

SEQ ID NO: 317338 - DNA, 550 bp, Homo sapiens
  misc_feature: GZ8MTXP02HJ796.41.86.H09.1.454.CMB.2.raw
  modified_base (361)..(361): a, c, t, g, unknown or other
  misc_feature (361)..(361): n is a, c, g, or t
  modified_base (440)..(440): a, c, t, g, unknown or other
  misc_feature (440)..(440): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccccctcaagagtcgtctcaccntttcgagggacacgtccatcgaaccgcttctccctgaaactgaccctcgtcgaccgccgcgacacggtccgtttattcngttgcgaggcgagactggtctttcaatctagtcggggtccgtgggccacccgtggtccacgtcgtcctccctcgacgtccttacccaccgaacgggccccacgttcccgg

SEQ ID NO: 317339 - DNA, 577 bp, Homo sapiens
  misc_feature: GZ8MTXP02J3YIA.41.86.H09.1.454.CMB.2.raw
  modified_base (366)..(366): a, c, t, g, unknown or other
  misc_feature (366)..(366): n is a, c, g, or t
tcagtctatactatcacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtgggctggatccggcacgcccccgagggaggggaatggagtggagttggtgacatccattatacgtggggcgacgtactactctccgtcccctacaagacgtcgtctcactnttcgagggacacgtccatcgaacccgcttacctccctagaaaactcgaaccctccgtgacccgccgacggaccacggtccgtttattcctgtgcgagggtccgagacgttggtcttttacgaattctaagtcggggtccgtgggacccctaccgtcgtacctcgtcgtcctcctcgtacgtcctaccgaaccgaccggtccctacgtcccg

SEQ ID NO: 317340 - DNA, 561 bp, Homo sapiens
  misc_feature: GZ8MTXP02JUX0F.41.86.H09.1.454.CMB.2.raw
  modified_base (362)..(362): a, c, t, g, unknown or other
  misc_feature (362)..(362): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtactactctccgtccccctcagacgtcgtctcacnttcgagggacacgtcatgaacccgcttctccctgaaacctgaccctccgtcgacccgccgcggaccacggtccgtttattcgtgtgcgaggcgagacgttggtctttcaattcgtagtcgggggtccgttgggccacccgttggtccacgttcgtcctcctcgacgtccttacccgaccgaacgggcccagttccccgg

SEQ ID NO: 317341 - DNA, 562 bp, Homo sapiens
  misc_feature: GZ8MTXP02IPCQI.41.86.H09.1.454.CMB.2.raw
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtgggctggactccggtacgccccgagggagggaatggagtggatggtgacatcctattatacgtgggcgacgtactactctccgtcctccaagacgtcgtctcacctagttcgagggacacgtccagtcgaaccgtctcctccctagaaactcgacctccgtgaccgcgcgacncgtcgttattcgtgcgngaggtcgagacttggtactttcaattcgtagtcggggcgtcggccgtaccgtggtaccacgttcgtcctcctcaacgtccttaccgaaccgacgggtcccctacgtcccggtttccccg

SEQ ID NO: 317342 - DNA, 601 bp, Homo sapiens
  misc_feature: GZ8MTXP02F6HVS.41.86.H09.1.454.CMB.2.raw
tcagtctatactatcacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaaacagacatggcatcgcacgtgggtccgccaggctccgaggcaaaggggctgggaggtgggtggctacttatagtggtatgataggaaattaataatattatagtaagtactttccggtaggaaagggtcccgtattaccaaccctaatcctacccaaggagaacaaagttccgaaaagaaccaactaacttaatactcgtaagggaaaattgaaaacttgcctaggaacgacggaccgaaggacctaccgggcttaggttactaacttacgtggtacgacggaagaagtaggtcgggggactcggtaggaactacgaaagg

SEQ ID NO: 317343 - DNA, 609 bp, Homo sapiens
  misc_feature: GZ8MTXP02H7NOE.41.86.H09.1.454.CMB.2.raw
tcagtctatactatcacgaccggtgctcgatttagtgctatagacttgggtttggggctggcaccaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtggctccagcactggacctgtcaccagtggtctattttccctactggctccaacagaagcctggccaacgcccccaggacactaatttatgatataactatagactagtcctggacacctcgcccgtcttctcacggcctccccgtccgttacggggacctaaacggcccgtccctcggtacccctttccgagtcgccgcgagcccgtggaggagtggaggtcgtagtacttagtttacgtgtcttcgtcctccttccgttagttacggttgggttaacgtcgggtagttcgggttaccggggcgggagggtaccgaagtcgtacggtaccgtcgtacggtcgacgcccgagccgtcgcccccgtggccctacgtccgtactcccctaccctccttac

SEQ ID NO: 317344 - DNA, 643 bp, Homo sapiens
  misc_feature: GZ8MTXP02H5W93.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcttggggctggatccggcagcccccgaggggaggggaagtggagtggagttggtgacatccattatacgtggggcgtacgtactacctctccgtccccctcaacgtatccgtctcacctgtttcggacggggacctacgtcccagtcgaacccgtccttctccctagaaactcgacccttcccgtcgacccgccgcgggacaccggtccgttttatttcgtggttcgcggtaacgggcgtaacgtacgttcgggtttctttacgaaacgttcgtaggtcgggggtccggttcgggtacctaccccggttgggtcctacgttcggttccttcccgtcgtaacgtcccgtttacccgaacccgaaacggggtcccctaacgtttcccccggg

SEQ ID NO: 317345 - DNA, 643 bp, Homo sapiens
  misc_feature: GZ8MTXP02GAMKY.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtactttccatctagttctgtatctattcgttggggctggatccgggtacgcccccgagggacgggagtggagtggagttggtgacatccagttagtacgtggggacgacgtactactctccgtcctacagtacgtcgtctcacctagtttcgacggactaccgtccatacgaaccgtccttccgtaccctacgtaaacctcgacccgtcccgtacgacccgtccggaccggacgtaccggtccgttttacgttccgtgttcggcgacgggcggtagtaccgtgggttacctttacgtaaacgttcgtacggtcgggggtccgtcgggtcctaccggttcggtacctacgttcgtccttcccgtacaacggtccttacccgaccgaaccgggccctacggttcccgtttcccccg

SEQ ID NO: 317346 - DNA, 675 bp, Homo sapiens
  misc_feature: GZ8MTXP02HQB6H.41.86.H09.1.454.CMB.2.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttcngtattctattcgttgggctggactccggcacgccccgagggagggatggagtggagttggngacagtctattagtacgtgggacacgtactacgtcctccgtccccctacaagtacgtcgtactccaacgtctttacggaggacctacgtaccacgtacgaacccgcttacctccctaagtaaacctcgaacccgttcccgtacggaccccgccggaccggaccgtaccgggttaccgtttttaactttccgttcgggttacggtaccgggacggggtacgtacggtacgttcgggttacttttacgtaaacgttcgttaacgggtcgggggtcccggttacgggcctaacccgttcggtacctacgtcgttcctcctaacgtctacccgttaccgaaaccgtacccgggtaccctacggtttcccccgg

SEQ ID NO: 317347 - DNA, 730 bp, Homo sapiens
  misc_feature: GZ8MTXP02HP1U0.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccgagggaggggaatggagtggagttggtgacatccattatactggggacgacgtactactctccgtccccctacaagacgtacgtctcactatttcgagggaccacgtccaatcgaaacccgcttcctccctagaaaaccgtcgaacccgttcccgtcggaaccccggcccggacccgggaaccgtacccgggtacccgttttaaacgttttccgttcggttcggaccggaacgggggaccgtaaacggtaaccgttcggggtttacccttttaccgtaaaacgttcccgttaaaacggttccggggggtaccccggttcggggacccgtaaaccccccggttcgggggttaccctaaccgtttccgggttcccttcccccggttaacctaacggtccccttttaccccgaaacccggaaaacccgggggtccccctaaacggtttccccccgggg

SEQ ID NO: 317348 - DNA, 565 bp, Homo sapiens
  misc_feature: GZ8MTXP02GCDGS.41.86.H09.1.454.CMB.2.raw
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (526)..(526): a, c, t, g, unknown or other
  misc_feature (526)..(526): n is a, c, g, or t
tcagtctatactatcacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggccaggactggtgaggccttcgggaaccctgtctctcatctgcactgtctctggtatttccatcagttctgatcattcgttggggctggatccggcacgccccgagggacggggaatggaggtggagttggtgacatcattatacgtgggcgtacgtactactctcctcccctcagtacgtcgtctcactgttcgacggacaccgtcaatcgaaccgtcttactccctanaaactcgaccctaccgtcgaccgcgtcgacncggtacctttattcgtgtgcgaggcgacgtacgtcggttactttacatcgtaggtcgggcgtcgacctaccggtgtacacgttcgtcctcncgacgtccttaccgaccgacgggccctacgtttccccgg

SEQ ID NO: 317349 - DNA, 589 bp, Homo sapiens
  misc_feature: GZ8MTXP02G35F2.41.86.H09.1.454.CMB.2.raw
  modified_base (311)..(311): a, c, t, g, unknown or other
  misc_feature (311)..(311): n is a, c, g, or t
  modified_base (469)..(469): a, c, t, g, unknown or other
  misc_feature (469)..(469): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtagtttccatcagttctgatcattcgttggggctggactccggcacgcccccgaggggacgggaagtggaggtggagttggngacgatcctattatacgtggggacgtacgtactactctccgtcccctacaagtacgtcgtctcacctgttacgagggaccaccgtccagtacgaacccgtcttcctcccgtaagaaacctcgaccctcgtcgacccgccgcggactccggtacctttnttcgtgtgacgtaggcgaagtctggtacttcaagttcgtagtcggggcctcggcctaccgtggtacctcgtcgtcctcctcgaactcccgttaccaccgacggtccctacgtttccccgg

SEQ ID NO: 317350 - DNA, 578 bp, Homo sapiens
  misc_feature: GZ8MTXP02GNX24.41.86.H09.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagtctatactatcacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctggggaggtccctgagactctctgtgtagctctggattcaccttnaaacngacatggcangnactgggccgcaggtcnccaggcaaagggtcnggagttgggcgcagtttaangtgtangagtagaaattaaatatgtatagtagtactcggtaggaacggtctattaccacatacacgaagaataactaataacgaaacgaaacaaactaactaatatagtaagtaaataagtaaatagacgtagaacgaagaccggacggaacgacggacgtacgtactactacgtagtacgaggaaggaaggaaggtacgggtacggtacggtacggtaacgtaacgtaacg

SEQ ID NO: 317351 - DNA, 679 bp, Homo sapiens
  misc_feature: GZ8MTXP02FPN4J.41.86.H09.1.454.CMB.2.raw
  modified_base (316)..(316): a, c, t, g, unknown or other
  misc_feature (316)..(316): n is a, c, g, or t
tcagtctatactatcacgaccggtgctcgatttagtgctatagacttgggttgggggagctctggggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggaggcggtggtccaggccgtgggacggtccctgagactctcctgtgtagcgtctggattcaccttcaacagacatggacatgccacgtcgggccnccaggcctccgaggaccgaaggggactgggaggttggggtggacaactttatagtggtatgtagtaggaaattaaagttaatattaatgttaagtacgtttacggtagggaaacgggtaccgtaattccaaacctacttaccgtacccgaaagacgtaaactaaacgtttacgaaaacgaaaccaaactaaacttaaactaagtacgttaaggaaaagtagtaaacgtacgaccgtagggaaaggaccggaaccgggaaggaaccggaacggccttacggttacctaaacggttactacgggtcgacgggaaaggaacggtaaggtcgggggtaccgtacggtaggtaaccgtaacgtaaagg

SEQ ID NO: 317352 - DNA, 670 bp, Homo sapiens
  misc_feature: GZ8MTXP02I1F2L.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtagtttccatctagttctgatctattcgtggggctggactccggcgacgccccgagggagggagtggaggtggtagttggtagacactctaattagtacggtggggaccgtaccgtacttacctccgttcccgtcccctacaaacgtcgtaccgtctccaacgtgtttacggaacgggtaccacgtaccctagtaccgaacccgttccttcctacccgtaacgtaaacgtccgtaacccgtccgtccggacccgtcccggaccggaccgtacggttccgttttacgttccgtggtggtaccggacgggacgtacggtacgttggttactttagaacttcgtacggtcggggtccgtcgaccgtaccggttgtactcgttcgtccgtaccctcgtaccgttccgttaacccgaccggtaccgggtaccctacgtttccccgg

SEQ ID NO: 317353 - DNA, 588 bp, Homo sapiens
  misc_feature: GZ8MTXP02GDXO1.41.86.H09.1.454.CMB.2.raw
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
  modified_base (512)..(512): a, c, t, g, unknown or other
  misc_feature (512)..(512): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatcattcgttgggctggatccggcacgccccgagggagggagtggagtgagtggtgactatcctaattagtacgtggggcgtacgtactactcctccgtcccctcaagagtcgtcncctaactnttcgacgggactaccgtcctatcgaaccgcttctccctagaacctgaccctccgcgaccgccgtcgacgtacgtctttattctgntacgaggcaagtcgtaggttctttacgaattccgtaggtcggggtcccgtcggtaccncccgttcgggtactaccgtcgttctcccgtaacgctaccttacccgaaccgtaaccgggcccctagtttcccccgg

SEQ ID NO: 317354 - DNA, 833 bp, Homo sapiens
  misc_feature: GZ8MTXP02FR8OP.41.86.H09.1.454.CMB.2.raw
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaacctgtctctcatctgcactgtctcgtggtacttccatcagttctagatctagttcgttggggctggactccggcgacggcccccggaggggacggggaagtgggaggtaggtagttcgggtagactacgtaccgtagtttaacgtacgggtcggggtaccggtaaccgttaacctaccgttacccgttccccgtacccccccgtacgtaaacggtacggtttccgttaccttacccgtaacccgttacggttttacccgggaaaccggggtaaccctaacccggttacccgtaaacgtaccgggtaaaccccgttccctttaccccgttaacccccgttaacggtaaaaaccccttccggtaaccccgttaccccggtacccggaccccggtaccccgggaccggtaaaccccgggttacccgggtttacccggtttttaacgtttcccgttcgggtacggtccgggacggggtaccggtacggttacgtttcgggttaccttttaacgaaacgtttcgtaacgggttcgggggtccgtacgggtccctacccggttcggtacctccgttcgttccctcgtaaccgtacgtacccttacccgaacccgtacgggacccctacggtttcccccgg

SEQ ID NO: 317355 - DNA, 658 bp, Homo sapiens
  misc_feature: GZ8MTXP02FLP81.41.86.H09.1.454.CMB.2.raw
tcagtctatactatcacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggccaggactggtgaggccgttcggaaccctgtctctcatctgcactgtctctggtatttccatcagttctgattctagttcgtggggtctggacgtccggcaccggccccgaaggggagggaagtggagtggtagttggtagactagtcctaagttacgtacggtacggggacgtaaccgtaccttacctcccgttcccgtaccccctacgaacgtacgttccgtactacctacctacgtttccggaaggtaccaccgtccagtacgaaccctcttaccttaccctagaaaccttcgacccgtccggccgaccgcccgacggaccgtaccggttccgttttattcgtgtcgcggtacgggtacgaagtacgttggttctttacgattcgtacggtcggggtccgtcgacctaccgtcggtacctcgttcgtcctaccgtcgaccgtaccttacccgaaccgtaccggtaccctacggttccccg

SEQ ID NO: 317356 - DNA, 682 bp, Homo sapiens
  misc_feature: GZ8MTXP02JNKGN.41.86.H09.1.454.CMB.2.raw
  modified_base (250)..(250): a, c, t, g, unknown or other
  misc_feature (250)..(250): n is a, c, g, or t
tcagtctatactatcacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctggtctctcagtctgccactgtctctggtacgtttccatcagttcngatcatcgtgggctggcgtcgcacgccccgaggggacggaagtggacggtggtacgttggtacgactacgtctagttacgtacgtcggggacgtacgtactaccgtcgtaccgtcccctaccgtaagtacgtcgtactccgactgtttaccgggacggtaccgacgtccgattacggtaaacccgtcttaccgtaccctagtaaaccgtcgtaacccgtcccgtacgacccggtccggaccggtaccgtcggttacccgtttagttccgcggtcgtacggcgtcggaacgttcgttcgggttaccttacaacgttcgtaacggtccggggtactaccggggtcctaaccggtcgtaaccgtacgttccggttcctacggtcctacggttaccccgttcgaacccggtaaccggtccctacggtttcccccgg

SEQ ID NO: 317357 - DNA, 615 bp, Homo sapiens
  misc_feature: GZ8MTXP01BZDTG.41.73.G07.1.454.CMB.2.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctctggtatttagttcagtagttctggcatgcacgtgggtccnccaggctcgaggcgaagggggccgagtggttggcagttanagcatatgatggaacttcgaagattaattatgacagacctccggtaggaaacgggccctattccacctatcctacccaagacgaacctaacgtaccccggaacacttacctacggttaacccgtagggtaaaatgaacttccgaacgtcccgtaggaacggtagggccggaacggtaccgttcgggaacctttcgttacggttaactttaccgtggttacggacggagttacggtaacggggtaaggtggacgaggttccgtaagttcgtttaagg

SEQ ID NO: 317358 - DNA, 664 bp, Homo sapiens
  misc_feature: GZ8MTXP01EDO9K.41.73.G07.1.454.CMB.2.raw
  modified_base (283)..(283): a, c, t, g, unknown or other
  misc_feature (283)..(283): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagtctatactatcacgaccggtgctcgatttagctctacgctcagggccgctgtgctctcggcggtgtttccattcggtgatcagcactgaacacagaggactcaccatggagtttgggctgagtcttgggttttcctcgttactcttttaagaggtgtccagtgtcaggtgcaccgtggtggagtcgtgggggagcgtggtccagccgtgggacgtccctgagctctctgtgagcctgtggtatttagttcagttagtctggcagtgcacgtgggtcccncaggcctacgaggcgaaggggccgagtggtggctagttanagctagtatgatggtaaccttgaagtacttattancggacagaacccttcggnggaaacgggccctaattcccgaacctagttccacaaggacaaaccgtaacgttaccccggaaacttccgttacgtacgtaaaccgtagggtaaaacttcggaactaccgaaacgtcccgtaaggaagggaacggccggaaaggtccgtcggtactcgttagttaacgtttaggcgaggaacggtaaggttagggtacggggttaagcgaaccgaggttcttaacggttaacgtttagttaaccggggttccggggttcgttacggtccggggttaacggggaacccgg

SEQ ID NO: 317359 - DNA, 608 bp, Homo sapiens
  misc_feature: GZ8MTXP01CPFY1.41.73.G07.1.454.CMB.2.raw
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagcttgggttttcctcgttactcttttaagaggtgtccagtgtcaggtgcaccgtggtggagtcgtgggggagcgtggtccagccgtgggacgtccctgagactctcctgtgaacgcctcgtggtatttagttcagtnttcnggcatgcacgtgggtcccncgaggcctcgaggcgaagggggccgagtgggttggctagttanagctatactgagtggtaacttcgaaagtattaattatgactagtaccgtcggtaggaaacgggtcctattccactatccaccaagacgaactaaccgttccccgaatcctacgtacgtaaccgtaggtaaactgaaactcgacgccgtaggaacggcggacggaggtacctcgggtcttcgttagttacgttacgttggtcgggacgagggttacgggttaacggggagttcggacgtgaccgtaacgttcgtttaacgg

SEQ ID NO: 317360 - DNA, 818 bp, Homo sapiens
  misc_feature: GZ8MTXP01EA1HB.41.73.G07.1.454.CMB.2.raw
  modified_base (315)..(315): a, c, t, g, unknown or other
  misc_feature (315)..(315): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagtcttggggtttttcctcgttacttcgttttaagaggtgtccagtgtcaggtgcacgtggtggagtcgtgggggagcgtggtccaggcctggggacgtccctgacgtactctccgtgtgaacgtcctgtggtatttagttcagtagtctggcatgctacgtcgggtcccncgaggcctacgacgggacgaaacggggggccggtaaggttcgggtttggacgtagtttaacgtggactagttaagtggtaaagtagggtaaacctttcgtaaaaggtaatttaagtttatcggtaccgtaaacggtacccggttaccggtaacggggtaaacggggtaccccttaactttacccgaaaccccgttattacccccgttaaccgaaaaccgggttaacggaaaaccccttaacccgtttaaaccccccgggaaaaccttacccttaccgtttaaccggttaaccccgggggttaaaggtaaaaccttccggtaacttaccccggtaagcccgttagggaaaccggggtacggaccgggtaaacggtccggtcgggtaactttacggttaaggtttactttacggaggttaccgggaggttaaaggttacggggttaaccggggaaaaggttcggggaaccgtaggacccttaagggttcccgttttaaacggggg

SEQ ID NO: 317361 - DNA, 522 bp, Homo sapiens
  misc_feature: GZ8MTXP02GM435.41.73.G07.1.454.CMB.2.raw
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (499)..(499): a, c, t, g, unknown or other
  misc_feature (499)..(499): n is a, c, g, or t
tcagtctatactatcacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggtcagactgttgacgacgacttagcctggtaccaacagaagcctggcccaggcctcccagactcctcatctatgatacttctagtggcctntggcatccccagccccgnttcagtggcaggtggggtctggggacagtacttcactctcaccatccaccagccctagacgccctagaagtattttgactagtttattactgtactacaacgtaagaagtgcctccaatatcacttcgcctggaccaagtgatatacaaaacgactgtggctgcaccatctntcttcactcctccgctactctag

SEQ ID NO: 317362 - DNA, 520 bp, Homo sapiens
  misc_feature: GZ8MTXP02GT459.41.73.G07.1.454.CMB.2.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (481)..(481): a, c, t, g, unknown or other
  misc_feature (481)..(481): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagttcagtagttctggcatgcactgggtccncaggctccaggcaaggggccggagtgggttggcagttatagcatangatggaacttctagatntatgcagctcgtgaacgggccattccacatctccagacgactaacttccccggaactactctacgtaccgtaggaaatgactcagcctgagaggcgaggactcggctcgtgtacttacgngtcgacgagagtcgggaagtcggacagtaccagtcttag

SEQ ID NO: 317363 - DNA, 679 bp, Homo sapiens
  misc_feature: GZ8MTXP02IT98E.41.73.G07.1.454.CMB.2.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggaggtccctgagactctctgtgaagcctctggatttagttcagttagttctggcatgcacgtgggtccnccaggctccgaggccgaaggggccgaggtgggttggctaggttatgcatatgatggaacttcgagattnttatgctagacctcggtaggaacgggccgtattccactatctacccgagtacgaacctaacgttaccccgggaaactaccgttaccgttacggttaaccccgtaagggtaaaacttcggtacttaccgaacggacccgttaggggaaacggacggggaccggaaacggggtacccgttccgggggtacctttccggttaggtttaaacgtttaacccggttgggttacgggaccggtaacgggtaagggttaaccgggggaaaaggttcggggaccgtaggggacctaacggggtacctttttaaacggg

SEQ ID NO: 317364 - DNA, 579 bp, Homo sapiens
  misc_feature: GZ8MTXP02GTBFL.41.73.G07.1.454.CMB.2.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
tcagtctatactatcacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggatgcgtggtccagcctgggaggtccctgagactctcctgtgaagcctctggatttagttcagttagttctggcatgcacgtgggtccnccaggctccgaggcaaggggccgagtggtgcagttatagcatatgatggaacttnagatatatgacagactccgtagaaggccgattcaacatcctaccagacgacaaacgttcccggaaactactactacgtaacccgtagggaaaacttggaaatccaaggcccttaggagaacgggcgaacggactcgggcttacgtaggttaacttacgtggtggaccggaagtacggtacgggaaacggttgggacaggccaagtcctaagtttacggcgggtcgtttaccgaaggtccggggg

SEQ ID NO: 317365 - DNA, 518 bp, Homo sapiens
  misc_feature: GZ8MTXP02FRO6Y.41.73.G07.1.454.CMB.2.raw
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctctggattttagttcagtagttctggcatgcacgtgggtcccgccaggctccgaggcaaaggggccggagtgggttgctagttanagcatatgatggaacttnagatntangcagactcgtagaacgggccattcacntcncagacaactaacttcccgaaacnctctacgtacctaggaaatgatcagcctagagaggcgaggacncggctcgtgtattacnggtcgacgagagtcgggaagtggacagcaggtcttaag

SEQ ID NO: 317366 - DNA, 645 bp, Homo sapiens
  misc_feature: GZ8MTXP02H6EDU.41.73.G07.1.454.CMB.2.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagtctatactatcacgaccggtgctcgatttagctctacgctcaggggagctctgggagaggagcccagcactagaagtcggcggtgtttccattcggtgatcagcactgaacacagaggactcaccatggagtttgggctgagcttgggttttcctcgttactcttttaagaggtgtccagtgtcaggtgcaccgtggtgagtcgtgggggagcgtggtccagccgtgggagtccctgagactctcctgtgaagcctcgtggtatttagttcagttagttctggcatgcacgtgggtccnccaggcctcgaggcgaaggggcggagtgggtgcagttanagnatngatgacttntagattattatagcgtaagtacctccgggtagaaacgggtcccgtattcccgaaccctattacccgacccgtaaaggaactaaacccgttaaaccccgttaccccgggaaaccttaacccgtaccgttacggttaaacccggttaagtaaacgttgaacgtaaccaccggccgtaagggaacggacgggacggacggtaccgtccggttctacgtttaggttacttacggcggtacgacggtaaggtacgggtaacggagtcggacgacgcgtaacgttacgttacgg

SEQ ID NO: 317367 - DNA, 639 bp, Homo sapiens
  misc_feature: GZ8MTXP02G30Z9.41.73.G07.1.454.CMB.2.raw
  modified_base (243)..(243): a, c, t, g, unknown or other
  misc_feature (243)..(243): n is a, c, g, or t
  modified_base (557)..(557): a, c, t, g, unknown or other
  misc_feature (557)..(557): n is a, c, g, or t
  modified_base (628)..(628): a, c, t, g, unknown or other
  misc_feature (628)..(628): n is a, c, g, or t
tcagtctatactatcacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtggggaggcgtggtccagccgtgggaggtccctgagactctcctgtgaagtccctntggtatttagttcagttagttctggctagtgctacgtcgggtcccgccaggcctccgagggacgaaggggccggagggttggtggactagttagtaggctagtatgagtaggtaacttcgtagaacttattagtgctaacggtaccttacggtcggaaacgggtcccgtaacttccgaaccctagttaccacccgaaagaaccgtaaacctaaaccgttccccggaaaactccttaccgttagtaaacccgtagggtaaaactgaactcgacgcgtaggacgaggacgaacgcctggtactcgtagttatacgngtacgaggacgtaggtacgggaagtcgacgtaacgcgaagttctaagtcggtccggtacgtttcgacgggnggtaacccggg

SEQ ID NO: 317368 - DNA, 653 bp, Homo sapiens
  misc_feature: GZ8MTXP02HSY92.41.73.G07.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (494)..(494): a, c, t, g, unknown or other
  misc_feature (494)..(494): n is a, c, g, or t
  modified_base (626)..(626): a, c, t, g, unknown or other
  misc_feature (626)..(626): n is a, c, g, or t
tcagtctatactatcacgaccggtgctcgatttagctctacgctcagggccgctgtgctctcggcggtgtttccattcggtgatcagcactgaacacagaggactcaccatggagtttgggctgagcttgggttttcctcgtttactcttttaagaggtgtccagtgtcaggtgcaccgtggtggagtcgtgggggaggcggtggtccagccgtggggacgtccctgacgactctcctgtagaacgcctctggtattttagttcagttagttcgtggctagtcgctacgtcgggcccncgacggccncgaggacgaaggggcgtaggtggtgcgtagttagngactatagtgagtagtaacttgtaagtataattagtcgacgtaacgtaccgtacgggtggtaacgggtctaacttacccaacctattaccacgaacgtaaacaaacccgtacttaccccggaatcccttacgtacgttaacgaaggtaaacngacctacgaacgtcgtaggaggcggacgtacgtacggtcgtcttagtagtttacgtacgtgacgtacggtacgggtaggttacgggaagtcgacgtagaccgtagtaaccgtttaggtcggtacccgggttntttaccgggacgggtacggggaaccgg

SEQ ID NO: 317369 - DNA, 635 bp, Homo sapiens
  misc_feature: GZ8MTXP01ECW5X.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggccctggacaaggacttgagtggatgggatggatcgagcgtcttaacaattggttaacaacaaacttatgacaacaagaaacctaccgagggcagacgtacaccatcgaaccaacacgaacaacactaccaacgacgacaacctagacccctaaacgacgtaggacgtcgtaggggaacggacgtccgtagaacgtactcgacgaaccgaccgtaccgggtccgttagttaacgttaacgtggttacggacggttaaggtacggtacgttacggcgttacgggttcccgggtaccccggttaacccggaccccgggtcgggggacccgtaacccggggttaaccccgtcggg

SEQ ID NO: 317370 - DNA, 644 bp, Homo sapiens
  misc_feature: GZ8MTXP01DG2A9.21.61.F06.1.454.CMB.2.raw
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggcccctggacaaggacttgagtggatgggatggatcagcgcttacaatggttaacacaaactatgacacagaaactccgaagggcaagacgtacaccatcgaccacagacacatccacgagacacagcctaacagtggaagccgtaggggaacgggacgaccgtaggagaactccgtaggaaaccgaccgaacgggcccgttggttaactttaaccgtggttaggacccggaaggtaaacggggtcccttttaaagggcccgttaaaggggtttcccggggaccccccggggttttcccgggaacccccccgggtttgggggggacccctaaccggggggttaaacccccgtttcccggggg

SEQ ID NO: 317371 - DNA, 661 bp, Homo sapiens
  misc_feature: GZ8MTXP01DQV21.21.61.F06.1.454.CMB.2.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaagtctcctgcaaggcttctggtttcacctttaccagctataatatcggctgggngcgacaggccctggacaaggcttgagtggatgggatggatcgagcgacttacaagttggtaacacaaactatgacaacaagaaacctcccgaagggcaggacgtaccaaccatacgaaccaacagacaacactacccaacgagaccaacgacgaccctaaacgagtacgggagaccgtagggggaacggggaacgtccctaggaaacgtacttccgaggaacccgacgaaccgggtcccgttagttaacgttaaccgttgggttcggaccggaaaggtacgggttccgtttaagggccgttaacgggttccgggggtacccccgggtttccggaaccccccgggttggggggaccccgtaaccgggggttaaccccgtttccggg

SEQ ID NO: 317372 - DNA, 587 bp, Homo sapiens
  misc_feature: GZ8MTXP01BBTEF.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggcccctggacaaggcttgagtggatggggatggatcagcgcttacattggttacacaaactatgacaacgagaaacctccgagggcagagtcaccatcgaccacagacacactccaacgagaccaacacgacctacagtgggaagcgtaggggacggacgtcctaggacgatcgtagaaccgacgaccgggtccgttaggtattaaccgtggttaggcgaaggaggtccttaaggccgttaggtcgggaccccgggttccggacccccggttgggggacccaacgggggttaaccccgttcggg

SEQ ID NO: 317373 - DNA, 637 bp, Homo sapiens
  misc_feature: GZ8MTXP01ENITY.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggcccctggacaaggacttgagtggatgggatggatcgagcgacttacaattggttaacaacaaactatgacaacaagaaacctccgaagggcagagtaccaccatcgacacagacacatccaagagacaacacgacctaacgatgggaagcgtaggggaacgggacgcctaggaacgtagtccgtacggaaccgacgaccggggtcccgttagttaacgttaacgtgggttacggacggttaagggacgggtccgtttaaggccgttaacgggttcccggggaccccgggttttaaccccgggaacccccgggttggggggaccccgtaaacgggggttaacccccgttcgggg

SEQ ID NO: 317374 - DNA, 529 bp, Homo sapiens
  misc_feature: GZ8MTXP01D2ITL.21.61.F06.1.454.CMB.2.raw
  modified_base (278)..(278): a, c, t, g, unknown or other
  misc_feature (278)..(278): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaggacttgagtggatgggatggatcagcgcttacaattggttaacacaaactatgacacagaaactccgagggcagacgtcaccatcgacacagacacatccacgagacacagcctanatgganctgggaggagcctagagatcngacgcacggccgtgtataacgtgttgcgagnggtcttagcttaggtcggcccggttcgaccccgtggggcctaacggggaaccccgtggg

SEQ ID NO: 317375 - DNA, 615 bp, Homo sapiens
  misc_feature: GZ8MTXP01DGCCU.21.61.F06.1.454.CMB.2.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggtttcacctttaccagtctataatatcggctgggncgacncggccctggacaaggcttgagtggatgggatggatcgagcgtacttacaagttaggttaacacaaactatgacaacaagaaactccgagggcagacgtacaccatacgaaccacagaaccacacgtaccaacgacgaccaacgacgacctaacgacgtacgggaacgcgttaggggaagggaccgtaccgtaggaacgacttacggacgaaccggaccgaccgggtccgttagtacttaacgtggcggtcgaaggacgggtcttaggcgttagggtcccgggcccggttccggacccccggttgggggaccctaacggggaacccgttcggg

SEQ ID NO: 317376 - DNA, 574 bp, Homo sapiens
  misc_feature: GZ8MTXP01EALLK.21.61.F06.1.454.CMB.2.raw
  modified_base (277)..(277): a, c, t, g, unknown or other
  misc_feature (277)..(277): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
  modified_base (397)..(397): a, c, t, g, unknown or other
  misc_feature (397)..(397): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggcccctggacaaggcttgagtggatgggatggatcgagcgnttacatgttacacaaactngacacagaaactccgagggcagagtacacatcgacacagacacactaccacganacacagaccctaacatgggaagcgtgggaacgggacgaccgtggacgatcgtaggaaaccgcgaacggtccgttagtacgttaactggttagcggttagacgggtcttaaggcgttacggtccgggtaccccggttccgaccccggtgggggaccctaacgggttaaccccgtcggg

SEQ ID NO: 317377 - DNA, 521 bp, Homo sapiens
  misc_feature: GZ8MTXP01CMOQ7.21.61.F06.1.454.CMB.2.raw
  modified_base (216)..(216): a, c, t, g, unknown or other
  misc_feature (216)..(216): n is a, c, g, or t
  modified_base (276)..(276): a, c, t, g, unknown or other
  misc_feature (276)..(276): n is a, c, g, or t
  modified_base (436)..(436): a, c, t, g, unknown or other
  misc_feature (436)..(436): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggtttcacctttaccagctataatatcggctgggngcgacaggcccctggacaaggacttgagtggatgggatggatcagcgcttacaatggttaacacaaactatgacacagaaactccagggcagagtcaccatgaccacagacacatccaagagacacagccctaacatggagctggaggagcctgagatcngaacgcacggccgtgtataacgtgttgcgaggaaggcttagcaggtcgcccggttcgaccccgtgggcccaaggggaacccctgg

SEQ ID NO: 317378 - DNA, 584 bp, Homo sapiens
  misc_feature: GZ8MTXP01AV1ZL.21.61.F06.1.454.CMB.2.raw
  modified_base (277)..(277): a, c, t, g, unknown or other
  misc_feature (277)..(277): n is a, c, g, or t
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggncgacaggccctggacaaggcttgagtggatgggatggatcagcgcttacattggtaacacaaactntgcaacagaaacctccgagggcagacgtcaccatcgaccacagacacatccacgancaacagacctacagtgggacgctaggggacggacgccgtaggagactcgtagacgacgcgggccgtaggttattaacgtggttggacggaggacggtacttacggcgttacgggttccggggtaccccggttccgggacccccggttggggggaccccgtaacgggggttaacccccgttcgggg

SEQ ID NO: 317379 - DNA, 662 bp, Homo sapiens
  misc_feature: GZ8MTXP01A57N5.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagtctataatatcggctgggncgacacggcccctggacaaggacttgagtggatgggatggatcgagcgcttaacaagttggttaacaacgtaaactatacgacaacaagaaacctcccgaagggccaagacgtaccaccatacgaaccaacagaacacactacccgaacgacgaccacacgacctaacagtggaagtcgtaggggaacgggacgtaccgtaggaacgtacgtccgtaggaaacccgaccgtaccgggtaccgttagttaactttaaccggtggttacggaccgggaaggtacgggtacccgtttaggccggttaacgggtccggggtcccccgggtttaaccgggacccccgggttgggggaccccgtaaccgggggttaaccccgttccgggg

SEQ ID NO: 317380 - DNA, 593 bp, Homo sapiens
  misc_feature: GZ8MTXP01ESN2Z.21.61.F06.1.454.CMB.2.raw
  modified_base (278)..(278): a, c, t, g, unknown or other
  misc_feature (278)..(278): n is a, c, g, or t
  modified_base (434)..(434): a, c, t, g, unknown or other
  misc_feature (434)..(434): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttcacctttaccagctataatatcggctgggncgacacggcccctggacaaggcttgagtggatgggatggatcgagcgtactttaacgaagttcggttaacaactaaactatcgacaacaagaaacctccgagggcagagtccacatcgacacagacacatccagacgacacagccctaagatggancgtaggggacggacgccgtagagactcgagaaccggacgaccggtccgttagttaacgttaacgtgttacggacgttaggaggtccttaaggcgttacggtccgggccccggtttaaccgaccccgggtggggaccctaacggggttaacccgttcggg

SEQ ID NO: 317381 - DNA, 673 bp, Homo sapiens
  misc_feature: GZ8MTXP01CZVXP.21.61.F06.1.454.CMB.2.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcaccttacagctataatatcggctgggtgcgacgacggcccctaggacaaggcttaggagtggatgggatggatcgagcgtactacaagtcgtaacactaaactactgacacaagaaactccgagggcagacgtcacancgaaccanacgacacacgtacccaacggacacaaccacgtaccctaaacgagtacgggacgtaccgtagggggaacggtaaccggccgttaggaacggtacgttcccggtaggaaacccggaacggtacccgggtacccgtttagttaactttaacccggtgggttaccggtacggaacggtacggtccgtttaaacggccggttaacggggttcccgggtacccccggggtttaaccggaaccccgggttgggggaccccgtaacgggttaacccccgtttcggg

SEQ ID NO: 317382 - DNA, 659 bp, Homo sapiens
  misc_feature: GZ8MTXP01DWZ19.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctggacaaggcttgagtggatgggatggatcgagcgcttacaattggttaacactaaactatcgacaacagaaacctccagggcagacgtacacatacgacacagacacactaccacgacgaccaacacgaccctaacgagtcgggaacgccgttagggggacggtacggcccttaggaagaacttcccggtaggaaacccggtaccgtaccggggtcccgttaggttaacgtttaaccgtgggttacggaccgggttaaggtacgggtcctttaacgggccgttacggggttcccggggtcccccgggtttaaccgggaccccccgggttggggggacccctaaccgggggttaaccccgtttccgggg

SEQ ID NO: 317383 - DNA, 610 bp, Homo sapiens
  misc_feature: GZ8MTXP01E1A4R.21.61.F06.1.454.CMB.2.raw
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggtttccacctttaccagtctataatatcggntgggncgacacggccctggacaaggacttgagtggatgggatggatcgagcgtattaacgaattggttaacactaaaactactcggacaacaacgaaacctccgaagggccaaggactaccaccatacggaaccaacgacgaaccaacacgtcccaacgacgaccaacacgccctaacgagtagggacgacgtagggggacggacgccgtagaagtactcgtacgaccgacgtacgggccgttaggtattaacgtggttcgacggagaggtcttaggcgttacggtccgggcccggttccggacccgtgggggacccaacgggttaacccgtcggg

SEQ ID NO: 317384 - DNA, 679 bp, Homo sapiens
  misc_feature: GZ8MTXP01BZRIT.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagctataatatcggctgggtgcgacacggcccctggacaaggcttgagtggagtggggatggatcgagcgtacttacgaattggttaacaactaaaactataggactaacgaagaaaacctccgaaggggcaagaacgtaccaaccatacgaaccacagacacactccaacgacgaccaacacgaccctacagagggaacgccgtagggggaacgggacgacccgtaggtaaacgacgtaccgtacggaaccgaccgtaaccggggtcccgttaggttaactttaaccggttggttagggaccggaaagggtacgggtcgtttaacggcggttaccggggttcccggggtacccccggggtttcccggaacccccggggttcgggggaccccgaacccgggggttaaccccgttcccgggg

SEQ ID NO: 317385 - DNA, 675 bp, Homo sapiens
  misc_feature: GZ8MTXP01A051U.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtncgacaggcccctggacaaggacttgagtggatggggatggatcagcgcttacgaatggttaacacaaactatagacacaagaaactcccaagggcagacgtacaccatacgaccacagacacactaccacgagaccaacacgaccctaacagtacgggagccgtaggggaacgggacgtacccgtagggaacgtaacgttccgtacggaaacccggaaccgtaaccggggtaccccgtttaggttaaatttaaccggttgggttacgggtaccggaagggtacgggtacccgtttaggccggttaaacgggttcccgggggtcccccggggttcccgggtaacccccgggttcgggggggacccccgtaacggggggttaaaccccccgttccggggg

SEQ ID NO: 317386 - DNA, 608 bp, Homo sapiens
  misc_feature: GZ8MTXP01DDGUJ.21.61.F06.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggncgacnggcccctggacaaggcttgagtggatgggatggatcgagcgtacttacgaattggttaacacaaaactntagacaacaagaaactccgagggcagagtacaccatcgaccacagacacatccaacgagacaacacgacctacagtggaagctaggggaacgggagacccgtaggaagaattcgaggaaaccgaccgaccgggtaccgttgttaactttaacgtggttggacggaggacggtcgttaggccgacgggttccggggtaccccggtttccgggacccccggttgggggaccctaacgggggaaccccgttaaccgggg

SEQ ID NO: 317387 - DNA, 638 bp, Homo sapiens
  misc_feature: GZ8MTXP01BXSX2.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttggagtggatggggatggatcgagcgtacttaacaattggttaacaactaaactactgacaacgaagaaaccgtaccgaggggcagacgtccaccatcgaccacagacaccatccaacgagaccacacgaccctagagtcgggacgtcgtaggggacggacgccgtaggaacggtactcgtacggaaccgaacggtacccggtccgttagttagttaaccgtggttcggacggttacggacgggtacttacgggccgttacgggttccgggtccccggggttaacccggacccccgggttcggggaccccggtaaccggggttaaccccgttccggg

SEQ ID NO: 317388 - DNA, 680 bp, Homo sapiens
  misc_feature: GZ8MTXP01DQVI5.21.61.F06.1.454.CMB.2.raw
  modified_base (282)..(282): a, c, t, g, unknown or other
  misc_feature (282)..(282): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctgagtgaaggtctcctgcaaggtcttcgtggtttcacctttaccagtctaataatatcggctgggtncgacacggcccctggacaaggcttgagtggatgggatggatcgagcgtacttaacgaattggttaacaactaaactatcggacaacgaacgaaaacctcccgaagggccaagacgtaccaacccatacgaccaacagaaccacacaccaacgacgaccaactacgacctaacgagtgggaaacgtccgtaggggaacgggacgtcccgttaggaagtaacttcgtacggaaaccgtacccggaccgggtacccgttagttaacgtttaaccgtgggttacgaccggaagggtacgggtccctttaagggcccgttaagggttcccggggtacccccgggtttccgggaaccccccgggttgggggaccccgtaacgggggttaacccccgttccgggg

SEQ ID NO: 317389 - DNA, 637 bp, Homo sapiens
  misc_feature: GZ8MTXP01DK1AJ.21.61.F06.1.454.CMB.2.raw
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcacctttaccagtctataatagtcggctgggngcgacacggcccctaggacaaggacttggagtggagtgggatggatcgagtcgtacttaacaagttcggttaacaactaaactactacgacaacgaacgaaacctcccgaagggcaagacgtaccacatacgaccacagacacactaccacgagacacacgacctacgagtggagtcgtaggggacggacgtacccgtaggaagtacgtccgtaggaaaccggaccgtaaccgggtccgttagttaacttaacgtggttacggacggaggtacggtcgtttaacggcgttacgggtccgggtccccgggttcggacccccgggtggggacccgtaacggggttaaccccgttccgg

SEQ ID NO: 317390 - DNA, 629 bp, Homo sapiens
  misc_feature: GZ8MTXP01ALQPR.21.61.F06.1.454.CMB.2.raw
  modified_base (277)..(277): a, c, t, g, unknown or other
  misc_feature (277)..(277): n is a, c, g, or t
  modified_base (436)..(436): a, c, t, g, unknown or other
  misc_feature (436)..(436): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatagtcggctgggngcgacacggcccctggacaggtacttggagtggagtgggatggatcgagcgacttacattggttaacaactaaactagtacgacaacaacgaaacctaccgaaggggccaaaggacgtaccaaccatcgaaccaacacgaacacactacccgaacgganaccacacgaccctaacagtacgggagccgtagggggaacggacgccgtaggaacgtagtccgtaggaacccgtacgtaccgggtccgttagtacgttaacgtggttgacggagacggtcgttagcgttacggtccgggtcccggttaacccgccccgggtggggaccccgtaacggggttaacccgttccggg

SEQ ID NO: 317391 - DNA, 590 bp, Homo sapiens
  misc_feature: GZ8MTXP01EN5R2.21.61.F06.1.454.CMB.2.raw
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacaggcccctggacaaggcttgagtggatgggatggatcagcgctttaacaagttggttaacaacaaactatgacaacgaagaaacctccgaagggcaagacgtcaccatacgaccanacgacacanccacgagacaacagccctaanatggaacgcgtaggggaaggacgcctagagaactcgacgaaccgacgaccgggtccgtgtaattaacgtggttacggcgttaggaggtccgttaaggcgacggtccgggccccggttccggacccccggtgggggaccctaacgggggttaacccctcggg

SEQ ID NO: 317392 - DNA, 688 bp, Homo sapiens
  misc_feature: GZ8MTXP01B0TXC.21.61.F06.1.454.CMB.2.raw
  modified_base (280)..(280): a, c, t, g, unknown or other
  misc_feature (280)..(280): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctcctgcaaggtcttcgtggtttcacctttacagtctataatagtcggctggngcgacgacggcccctggacaaggtcttgagtggagtgggatggatcgagtcgtacttaacgaagttcggttaacaactaaaacttagtacggactaaaccgaaacgtaaaaccgtcccgaaggggaaccgaaaggtaacgttacccaaacccgtaagtaccggaaaccccaaacgaacgaaccaaccaactacccgaaacgacgaccaaccgacgaccctaacgagttacgggaacgacgttacggggaacggtaaccgcccgttaaggaacggtactccgtaggaaacccggtacgtaccgggtccgttagttaacttaacgtgttacggacgagacggtcttacgcgttacggtcgggtccccgttccgaccccggtggggacccgtaaccgggaacccgtccggg

SEQ ID NO: 317393 - DNA, 617 bp, Homo sapiens
  misc_feature: GZ8MTXP01CADWX.21.61.F06.1.454.CMB.2.raw
  modified_base (276)..(276): a, c, t, g, unknown or other
  misc_feature (276)..(276): n is a, c, g, or t
  modified_base (463)..(463): a, c, t, g, unknown or other
  misc_feature (463)..(463): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctatatatcggctggngcgacacggcccctggacaaggacttgagtggatgggatggatcgagcgacttacaagttggttaaacaactaaaacgtatacggacaaacgaaacgaaaaccgtcccgaaaggggccaaaggaacgtaccaacccatacgaacccaacagtaacaacgactaccaacgacgacaacagaccctaanagtggaacgcgtaggggaggacgtccgagagatcgagaacgcgtacggctagtattaacgtgttaggcgagacggtcttacggcttacgggtccgggtccccggttccggaacccccggtgggggaccccaacgggggttaacccccgttcggg

SEQ ID NO: 317394 - DNA, 608 bp, Homo sapiens
  misc_feature: GZ8MTXP01AN03U.21.61.F06.1.454.CMB.2.raw
  modified_base (349)..(349): a, c, t, g, unknown or other
  misc_feature (349)..(349): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttacagtctataatatcggctgggtgcgacacggcccctaggacaaggcttgagtggatgggatggatcagcgtacttacatggttacacaaactntcgacaacgacgaaactccgagggcaggacgtacaccatacgaacacgagacacactaccacgacgacaccacgcctaacagtcggacgcgtaggggaaggtacgcctaggaacgattcgacggaaccgtacggtaccggtacccgttagttacgttaacgtggttacggacgagggacgtcgttagccgttacgggtccgggtaccccgggttccgaccccgggtcgggggaccccgtaacgggaaccccgttccggg

SEQ ID NO: 317395 - DNA, 630 bp, Homo sapiens
  misc_feature: GZ8MTXP01A9B0V.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggncgacacggcccctggacaaggacttgagtggatgggatggatcgagcgacttacaattcggttaacaacaaaacttactcggacaacaacggaaaaccttacccgaaagggggaaccaaaggaacggttaccaaaccccgaagttacggaaaccccaacaacgaaccaacaactacccgaaacgacgacaacacgacctaacgacgtagggaagcctaggggacggaacgcctaagacgatcgtagaaccgacgacggtccgtagttagtaacgtgttggacgaggagtcttagcgacggtcggtccccggttcgaccccggtggggacccgtaacgggttaacccgtcggg

SEQ ID NO: 317396 - DNA, 677 bp, Homo sapiens
  misc_feature: GZ8MTXP01DBPZT.21.61.F06.1.454.CMB.2.raw
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgacaaggtcttcgtggtttccacctttaccagtctataatatcggctgggncgacacggcccctggacaaggtcttggagtggatgggatggatcgagcgtactaagagttacggttaacacgtaaaacttagtacggacaacgaacgtaaacctacccgaagggccaaaggacgtaccaaccacgtacgaaccacgacgaaccaaccaactaccaacggaacaccaaccaacgacccctaaagagtacggaacgtcgtaggggaacggtacgaccgtagagtacgtacgacggaaccgaccggtaccggtaccgttagttaacttaacggtggttacggacggaggtacggttacgttacggccggttaccggggtcccgggtaccccgggttccccgggaccccgggtacggggaccccggtaaccggggttaacccgtccgg

SEQ ID NO: 317397 - DNA, 612 bp, Homo sapiens
  misc_feature: GZ8MTXP01CHEYQ.21.61.F06.1.454.CMB.2.raw
  modified_base (277)..(277): a, c, t, g, unknown or other
  misc_feature (277)..(277): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggngcgacaggcccctggacaaaggcttggagtggatggggatggatcagcgattacaattggttaacacgaaaactatgacaacgaagaaaacctcccgaagggccaagacgtacacctaanacgaacacanacacacaccagacacaacacaccaacgagtaggagcgaggggacggacgtcagaacgtactacgtaacgacgcgtcgttagttacgtcgtggtacgacggtagacggtacgtacggttaccgttcgggttcccgggtaaccccggttacccgggtaaccccgggtccgggacccggttaccgggtaaccccgttccggtaacccg

SEQ ID NO: 317398 - DNA, 696 bp, Homo sapiens
  misc_feature: GZ8MTXP01AR075.21.61.F06.1.454.CMB.2.raw
  modified_base (272)..(272): a, c, t, g, unknown or other
  misc_feature (272)..(272): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctgagtgaagtctctgcaggcttctgtttcacctttacagtctatatgtcggctgggngcgacgacggcccctaggacaaggtacttgagtggagtgggatggatcgagcgtacttaacaagttacggttaacaactaaactctacgacaaacgaacgaaacctacccgaagggccaaggtacgtacccaaccctagtaccggaacccaaacgacgaaccaaccaactacccgaaaccggacgacccaaccgacgtaccctaacagtacggacgtacgtacggggaacgggtacgtaccgaggtaacgtaacgtccgtaacggaacccggacgtaccgggtaccgttagttacgttaaccgtggttacgacggttaaggtacggtctttaacggccgttacggggttccccgggtaccccgggtttccccgggaccccggggttcgggggaccccgtaaccggggttaaccccgttcccggg

SEQ ID NO: 317399 - DNA, 659 bp, Homo sapiens
  misc_feature: GZ8MTXP01DG6SB.21.61.F06.1.454.CMB.2.raw
  modified_base (277)..(277): a, c, t, g, unknown or other
  misc_feature (277)..(277): n is a, c, g, or t
  modified_base (432)..(432): a, c, t, g, unknown or other
  misc_feature (432)..(432): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttcacctttacagctatatatcggctgggtncgacaggcccctggacaaggacttgagtggatgggatggatcgagcgacttaacaaagttcggttaacactaaaactatacggacacgtaaacgaaaaccttcccgaaggggtccaaggacgttaccaaccgatcggaacccaacgacgacacanacccagacgacacacgcctaacaacgtggaacgcgtaggggaacggacgtccgtagacgtacgtcctaggaaccgaccgtacgggtaccgtgttattaaccgtggttaggcggttaagggacgggtcgtttaaacggccgttaacgggttccggggtacccccgggtttcccggacccccgggttcggggggaccccgtaacgggggttaaacccccgtttccgggg

SEQ ID NO: 317400 - DNA, 569 bp, Homo sapiens
  misc_feature: GZ8MTXP01DN64P.21.61.F06.1.454.CMB.2.raw
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttcacctttaccagctataatatcggctgggtgcgacaggccctggacaaggcttgagtggatgggatggatcgagcgacttacaagttcggttaacacgtaaactatgacacagaaactccgaagggcagacgtcacatacgacanacgacacatccacgagacacacgacctacagtggacncgtgggacggagacctagagactcgagaaccgacgtacggtccgtgtattaacgtggttcgacgagtacggtcttaaggcgaggtccgggacccggttcgaccccggtgggggaccctaacggggttaacccgttcggg

SEQ ID NO: 317401 - DNA, 652 bp, Homo sapiens
  misc_feature: GZ8MTXP01A1W96.21.61.F06.1.454.CMB.2.raw
  modified_base (276)..(276): a, c, t, g, unknown or other
  misc_feature (276)..(276): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggncgacaggcccctggacaaggcttgagtggatggggatggatcgagcgnttaacattggttaacacgaaactntgacacgagaaactccgagggcagagtcacatgaccanagacacactccacgagacacagaccctacagtggaacgcgtaggggacggtacgcccgtaggaagtacgtcgtacggaaccgaaccgaccggggacccgttaggttaactttaacccgtggtttacggaccggttagggaacgggtaccgttttaacgggcccgttaaaggggttccccgggggtccccggggtttaaccccggtaccccccggggttaggggggttacccccggaaaccgggggttaacccccgtttcccggggg

SEQ ID NO: 317402 - DNA, 652 bp, Homo sapiens
  misc_feature: GZ8MTXP01A5N1L.21.61.F06.1.454.CMB.2.raw
  modified_base (356)..(356): a, c, t, g, unknown or other
  misc_feature (356)..(356): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttacagtctataatagtcggctgggtgcgacacggcccctggacaaggacttggagtggatgggatggatcgagcgtacttacaattggttaacaacaaactntgacaacgaagaaacctccgaagggcaaggacgtaccaaccatcgaacccaacacgaaccacaactccgaacgagacccaacacgacccctaagagtgggacgtaccgtaggggacgggacgtccgtaggaagtactccgtaggaacccgtacgtaccggggtccgtagttaacgttaacgtgggttacgacgggaggtacgggtcctttaaggccgttaacgggttccggggcccccggtttaacggaccccccgggttgggggacccctaaccgggggttaaccccttccgggg

SEQ ID NO: 317403 - DNA, 608 bp, Homo sapiens
  misc_feature: GZ8MTXP01DT2FK.21.61.F06.1.454.CMB.2.raw
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctggggcctcgagtgaaggtctcctgcaaggtcttctggtttcacctttaccagtctataanatcggctgggtncgacacggcccctggacaaggcttgagtggatgggatggatcagtcgacttacgaattggttaacaacaaacttancggacaacgagaaacctccgaagggcagacgtccaactagacgaccaagacaacacacaccacgacgacactacgccctaanagnggaacgcgtaggggaacggcgtccgagaacgtacgtgaccgaacggaccgtacggtccgtagttaactaacgtggttagccggaaggacgttcgttaacgcggttaacggtcccgggtacccggtccgtcccgggacgggacccggtaacgggttaacccgtccgg

SEQ ID NO: 317404 - DNA, 669 bp, Homo sapiens
  misc_feature: GZ8MTXP01B81JT.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtgcgacacggcccctggacaaggacttggagtggatggggatggatcgagcgtactttaacaagttggttaacaacaaactatgacaacgaacgaaacctcccgagggcaagacgtcaccatacgaccacagacacactacccaagacgaccacacgaccctacgagtgggacgccgtaggggaacggtacgcccgtaggacgtacgttccgtacggaaccgaccgtaaccgggtcccgttagttaacgttaacgtgggttacggacggttacgggtaacgggtacgtttacgggccggttaacgggttccgggggtacccccgggtttaacccgggtaccccccgggttacggggggaccccgtaaccgggggttaacccccgtttccggggg

SEQ ID NO: 317405 - DNA, 634 bp, Homo sapiens
  misc_feature: GZ8MTXP01DJDB4.21.61.F06.1.454.CMB.2.raw
  modified_base (279)..(279): a, c, t, g, unknown or other
  misc_feature (279)..(279): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttcacctttaccagtctataatatcggctgggncgacacggccctggacaaggtactgagtggatgggatggatcgagcgtactaacaagttcgttaacaactaaactntagacacgaacgaaacctccgaagggcagacgtacaccatacgaaccacaacgacaacactaccaacgacgacaacacgaccctaagagtgggaagtccgtagggggaaacggggacgacccgtaggaacgtactcgtaggaaacccgtacgtaccgggtccgtagttacttaacgtggttacggacggagtacggtcttaacggcgttacgggtccggggtaccccggttccggaccccgggtcgggggacccgtaaccggggttaaccccgtccggg

SEQ ID NO: 317406 - DNA, 671 bp, Homo sapiens
  misc_feature: GZ8MTXP01EDK66.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagcctggggcctcgagtgaaggtctcctgcaaggcttctggtttccacctttaccagtctataatagtcggctgggtgcgacacggcccctggaacaaggtcttgagtggatggggatggatcgagcgtcttacaattggtaacacaaactactgtaacaagaaacctccgaagggcaagtagtaccaaccatacgaccacagaccacatcccgaacgagaccaacgacgaccctaacagtaggacgacgtagggaacggggacgtccgttaggaacgtacgttaccgcggaaaccgaccggtaccgggtcccggttaaggttactttaaccggtgggttacggaccgggtaaaggttaacgggtcgttaaacgggcgttacggggttccgggtcccccgggttaacccggaaccccggttggggggaccccgttaacgggggtaaccccgttgggggtaaccccc

SEQ ID NO: 317407 - DNA, 666 bp, Homo sapiens
  misc_feature: GZ8MTXP01C4G1C.21.61.F06.1.454.CMB.2.raw
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctnagtgaaggtctctgcagtcttctgttcacttacngtactatatatcggctgggcncgacgacggcccctggaacaaggtcttgagtggatggggatggatcagcgtacttacgaagttcggttaaacaacgtaaactgtacgaccaacaaacgtaaaccctcccggaagggcaaggtacgtaccacctatacgaaccaacacgacctacaactccgaaccgagactaaccacgtacctaacgagtacgggactccgtagggggaacgtacgtaccgtagaacgtacctcgtacggaaaccggtaccgtacgggtaccgttagttaacttaacggtaggttcgacgggttaagtacggtcctttaggccgttcggggttccccgggtacccggtttccccgggacccgggtcgggggttaaccctaaccggggttaaccccgtttccggg

SEQ ID NO: 317408 - DNA, 610 bp, Homo sapiens
  misc_feature: GZ8MTXP01EG2OL.21.61.F06.1.454.CMB.2.raw
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (439)..(439): a, c, t, g, unknown or other
  misc_feature (439)..(439): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggcctnagtgaagtctcctgcaaggcttctggtttcacctttaccagctatatatcggctgggngcgacaggcccctggacaaggcttgagtggatgggatggatcagcgtacttaacgaattggttaacaactaaactatcgacaacaagaaacctcccgaagggcaaggacgtaccaccagtcgaaccacagaacacactaccgacgaagaccaacacgaccctaanacgtgggaacgccgtaggggacgggaagcccgtaggaagtactcgtacgaaccgaccgacggtccgtagttacttaacgtgttagcggagaggtcttaggcgttacgggtccgggtccccgggttccggaccccgggtcggggacccgtaaccggggttaacccgttcggg

SEQ ID NO: 317409 - DNA, 732 bp, Homo sapiens
  misc_feature: GZ8MTXP01A4PDD.21.61.F06.1.454.CMB.2.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcgagtgaaggtctcctgcaaggcttcgtggtttcacctttaccagtctataatatcggctgggtncgacnggcccctggacaaggcttgagtggatgggatggatcgagcgtacttaacgaagttcggttaaccaactaaaaccgttatacggacaaacgaaacgtaaaacctacccggaaaggggcccaaagggtaacgtacccaacccgtaagtacgaaacccaaacaacgaaccaaccaactcccgaacgacgaccaaacacgaccctaaacagtaggaacgtccgtagggggaacggggtacgacccgttaggaaacgtacgttacccgacgggaaacccgaaccgtaaccggggtcccgtttaagttaacgttaaccggtggttacggaccgggttaaggtacggggtacgtttagggcccggttaacggggttcccggggtacccccggggttccggaacccccggggttgggggaaccccgtaaccgggggttaaccccgttcccgggg

SEQ ID NO: 317410 - DNA, 649 bp, Homo sapiens
  misc_feature: GZ8MTXP01BMCVS.21.61.F06.1.454.CMB.2.raw
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttccacctttaccagtctataatagtcggctgggngcgacacggcccctggacaaggacttgagtggatgggatggatcgagcgtcttacgaagttggttaacaactaaactagtagacaacgacgaaacctaccgagggcagacgtacaccatacgaccacgagacaacactaccacgacgacacacgacctaacgagtggaagtcgtaggggaacgggaccgtacctaggaaccgtagtacccgtaggaaacccgtaccggaccgggtccgttagttagttaaccgtggttcggtacggaggtaacggtcgttaacggccgttagggtccccggggtccccggttaaccgggtacccccgggtcgggggaccccgtaaccgggggttaaccccgttccggg

SEQ ID NO: 317411 - DNA, 637 bp, Homo sapiens
  misc_feature: GZ8MTXP01CXEL6.21.61.F06.1.454.CMB.2.raw
  modified_base (218)..(218): a, c, t, g, unknown or other
  misc_feature (218)..(218): n is a, c, g, or t
  modified_base (287)..(287): a, c, t, g, unknown or other
  misc_feature (287)..(287): n is a, c, g, or t
  modified_base (507)..(507): a, c, t, g, unknown or other
  misc_feature (507)..(507): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtcctccgtgctaaggtcttcgtggtttccacctttaccagtactataatagtcggctgggncgacgacggcccctaggacaaggcttggagtggatgggatggaatcgagtcgtactaacgaagttacggttaaacaactaaaactactcggacaacgaaacgtaaacctaacccgaaggggcaaacggtacgtaccaaaccgactacggaaacccaacgacgaactaacactaccgaacgacgacacacgtacctacagtgaacgtcgtaggggaacggngtacctaggagactcgtacggaacgtaccgtacgggtcctagttactaagtggagcgaggtacgtcttaggcgttacggtccgggtcccggtcgaccccggtggggaccctaacgggttaaccccgtcgg

SEQ ID NO: 317412 - DNA, 621 bp, Homo sapiens
  misc_feature: GZ8MTXP01EJA5M.21.61.F06.1.454.CMB.2.raw
  modified_base (215)..(215): a, c, t, g, unknown or other
  misc_feature (215)..(215): n is a, c, g, or t
  modified_base (406)..(406): a, c, t, g, unknown or other
  misc_feature (406)..(406): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctgggcctnagtgaaggtctcctgcaaggcttctggttctacctttaccagtctataatagtcggctgggcgacgacaggcccctaggacaaggacttggagtggagtgggatggatcgagcgtacttaacgaagttggttaacaacaaactatgacaacgaactaaaccgtccgaagggtcaagaacgtaccaacctanacgaaaccaacgacgaacaacactacccgaacgacacaacctagacccctaagagtacggaagtcgtaaggggacgacggcctaagacgatccgagaaccggcgtacgggtacctaggttactaacggtgttcgaggagtacggtgttaacgcggacgggtcccggtcccggtaaccggccccgggtggggacccgtaaccggttaacccgtcgg

SEQ ID NO: 317413 - DNA, 664 bp, Homo sapiens
  misc_feature: GZ8MTXP01DWCN5.21.61.F06.1.454.CMB.2.raw
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggcctcagtgaagtctctgcaaggtcttctgtttcaccttacagtctataatatcggctgggtgcgacgacggccctggacaaggtcttgagtggatgggatggatcgagcgtacttaacagttacggttaacaacaaaacttatacgacaacgaacgaaaacctcccgaaggggccagaacgtaccaaccagtacgaaccaacacgacaacactcccgaaagacgactaacacgtaccctaacgagtacggacgacgttacgggggaacggtacgtacccggtaggaacggtacttccggacggaacccgaaccggtaccgggttacccgttagttacgttaacggtggttacggacggttaggtacggtcgttaacggccgttacgggtcccgggtccccggttaaccggaccccgggtggggaccccgtaacggggttaaccccgttccggg

SEQ ID NO: 317414 - DNA, 664 bp, Homo sapiens
  misc_feature: GZ8MTXP01DQT6F.21.61.F06.1.454.CMB.2.raw
  modified_base (284)..(284): a, c, t, g, unknown or other
  misc_feature (284)..(284): n is a, c, g, or t
  modified_base (633)..(633): a, c, t, g, unknown or other
  misc_feature (633)..(633): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtagaagaaggccgtggggcctcgagtgaaggtctctgacaaggtcttcgtggtttcacctttacagtactataatatcggctgggncgacgacggccctggacaaggacttgagtggatgggatggatcgagcgtactaacgaagttcggttaaacacaaaacttatacgacaacgaaacgaaaccgtacccgaagggaaccaagggaacgtaccaaacctactacggaaacccaaacgaacgaaccaacacacccaacggaacaccctaacacgtacccctaagaagcgggaacgtccggtaggggaacggtacgaccgtaggataccgtcgaacggaaccgaccgtcgggtaccgttagttacgtaacgtggagtacggaagtacgtcgttacgcggttacggtccccgggtcccggtaaccgggtccccggngggggacccgtaacgggttccccgttccggg

SEQ ID NO: 317415 - DNA, 633 bp, Homo sapiens
  misc_feature: GZ8MTXP01B1PCX.21.61.F06.1.454.CMB.2.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagctgaggtgaagaagccgtggggcctcgagtgaaggtctcctgcaaggtcttctggtttcacctttacagtctataatntcggctgggncgacaggcccctggacaaggcttgagtggatgggatggatcgagcgtacttaacgatcggttaacacgtaaactntagacacaagaaactccgaagggcaagacgtcaacctagacgacacagaacacactaccgaacgagacacgacgcctaacagacggaagccgtaggggacggacgcccgtagacgtacgtcgacgaccggacgtaccgggacccgttaggttacttaaccgtggttccggaggacggtacgggtactttaacgggccgttacgggtccggggtcccccggttccgggtacccccggtgggggaaccccggtaaccggggttaaccccgttcccgggg

SEQ ID NO: 317416 - DNA, 581 bp, Homo sapiens
  misc_feature: GZ8MTXP01BMFPQ.21.61.F06.1.454.CMB.2.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaagtctcctgcaaggcttctggttcacctttacagtctataatatcggctgggncgacaggcccctggacaaggcttgagtggatgggatggatcgagcgactttacaattcggttaacacaaacttngacacgaagaaactccgaagggcagtacgcaccaanacgacacanactacactaccgaacganaccacacgtaccaagagtacggacgcgtaggggacggtacgccgtagactcgtcgacgaccgtacgtccggtcgttagtctaacgtggcgacgagtacggtcgttacggcgttacgggtccggtcccggtaaccgacccggtcggggacccgtaacgggttcccgtcgg

SEQ ID NO: 317417 - DNA, 695 bp, Homo sapiens
  misc_feature: GZ8MTXP01BIXMK.21.61.F06.1.454.CMB.2.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (451)..(451): a, c, t, g, unknown or other
  misc_feature (451)..(451): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctgggcctnagtgaaggtctcctgcaaggtcttctggtttcacctttaccagctatatagtcggctggngcgacgcggccctggacaaggacttgagtggatgggatggatcgagcgtacttaacgaagttcggttaaacactaaactatacgacaacgaacgaaacctccgaagggcagtaccgtacaaccagtacgaaccaacaagaccaacaactacccaacgacgaccaacacgaccctaanagtaggaactccgtaggggaaacgggtcgtaccgtaggaagtacgtccgtacgggaaacccgaaccggtacccgggtaccgtttaggttaacgtttaaccggtggttacgggaccggttaaagggtacgggttaccgtttaagggccgttaacgggggttccccgggtacccccggggttttaacccgggacccccgggttcggggggaccccgtaacccgggggttaacccccgttcccgggg

SEQ ID NO: 317418 - DNA, 617 bp, Homo sapiens
  misc_feature: GZ8MTXP01DB3B3.21.61.F06.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (414)..(414): a, c, t, g, unknown or other
  misc_feature (414)..(414): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctcagtgaaggtctctgcaaggcttctggtttcacctttaccagtctatatatcggctgggncgacncggccctggacaaggcttgagtggagtgggatggatcgagccgtacttaactaagttacggttaacacgtaaactatacgacaacgaacgaaacctccgaagggcaacgacgtacaccgatacgaacccanacgacacactaccgagacgacacagaccaacagtggaacgcgtaggggacggacgtaccgtaggacgtactcgtacggaaccgaccgtaccgggtccgtgttaattcgtggttggacggaggacgggtcgttaacggcgttacgggtccgggtacccggttccggaccccggtcggggaccgtaaccggggaacccgttcggg

SEQ ID NO: 317419 - DNA, 710 bp, Homo sapiens
  misc_feature: GZ8MTXP01CMBHG.21.61.F06.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (502)..(502): a, c, t, g, unknown or other
  misc_feature (502)..(502): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctgagtgaaggtctcctgacaaggtcttcgtggtttcacctttaccagtctataatagtcggntgggngcgacgacggccctaggacaaggcttgagtggagtgggatggatcgaggtcgtacttaacgaaagttcggttaaaccaaacgtaaaacttacgtacggacaaacgtaaacggtaaaaccctccgggaaaggggaaccaaggtaaacgttacccaaaccccaagtaccggaaacccaacgaacgaaccaacactaccaacggacgacaacacgaccctanagtacggacgacgtaggggaacggacgcctaggaagtctacgacggaaacgacgtaccggtaccgttagttaacgttaacgtggttcggacgttagggtaacggtcgtttacggacggttaccgggttccggggcccccggggtttaacccggtaccccgggtacgggggttaccccgtaacccgggggttaacccgtttccccgggg

SEQ ID NO: 317420 - DNA, 672 bp, Homo sapiens
  misc_feature: GZ8MTXP01ED3NI.21.61.F06.1.454.CMB.2.raw
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctnagtgaaggtctcctgcaaggtcttctggtttccacctttaccagtactataatagtcggctgggtncgacgacggccctggacaaggcttggagtggagtgggatggatcgagtcgtacttaacgaattacggttaacaaactaaactacgtacgacaacgaacgaaaccctacccggaaggggtccaaggtaacggtacccaaaccctagtaccggaaacccaacgaacgaaccacaactcccgaagacgaccaacaacgccctaacgagtcgggaacgtcgtagggggaacggacgtcccgtaggacgtacgtccgtacggaaccgaccgtaccgggtacgttacgttacgttaacgtggacggacggttaggtacggtacgttacggcgttacgggtccggggtcccggttccgacccgggtcggggaccctaacggggttaacccgtcggg

SEQ ID NO: 317421 - DNA, 654 bp, Homo sapiens
  misc_feature: GZ8MTXP01D1NIG.21.61.F06.1.454.CMB.2.raw
  modified_base (279)..(279): a, c, t, g, unknown or other
  misc_feature (279)..(279): n is a, c, g, or t
  modified_base (469)..(469): a, c, t, g, unknown or other
  misc_feature (469)..(469): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaacgccgtggggcctcagtgaaggtctcctgcaggcttctggttcacctttaccagtctataatagtcggctgggngcgacgacggcccctaggacaaggtacttggagtggagtggggatggaatcgagtcgtactttaacgaagttcggttaacaactaaactatacgacaacgaacgaaacctaaccgagggcagacgtacccaccgtagtacgaaccaacacgactaacgactacccgaagacaccgaacacgacccctaanagtggaactcggtaggggaacgggcgtaccgtaggacgtacgtaccgtaggaacccgaccggtacgggtccgttagttagttaacgtggttaggacggttagacgggtcttaacgggcgttacggggttccggtccccgggttccgccccgggtcggggaccgtaaccggggttaacccgtccgg

SEQ ID NO: 317422 - DNA, 666 bp, Homo sapiens
  misc_feature: GZ8MTXP01BGQHR.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaagtctcctgcaaggcttctggtttccacctttacagctataatagtcggctgggngcgacgacggccctggacaaggtctgagtggatgggatggatcgagcgtacttaacgaagttcggttaacaactaaacttacgtacgacaacaacggaaacctacccgaaggggcaagggaacgtaccgaaccctagtaccgaaccaacgacgaaccacctaacaccgaacgagaccaacagaccctaacgagtacggagtcgtagggggacggacgcctaggaacgtagtcgtacggaaccggtacgaccggggtccgtagttagttaaccggtggttcggacggttaggtacgggtacgtttacgggccgttacgggtccgggggtaccccgggttaaccggacccccgggtgggggaccccgtaacgggggttaaccccgttcggg

SEQ ID NO: 317423 - DNA, 594 bp, Homo sapiens
  misc_feature: GZ8MTXP01AUABU.21.61.F06.1.454.CMB.2.raw
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (246)..(247): a, c, t, g, unknown or other
  misc_feature (246)..(247): n is a, c, g, or t
  modified_base (264)..(264): a, c, t, g, unknown or other
  misc_feature (264)..(264): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctgggcctcagtgagtctctgcaggntntgttcacttacnnctatatatcggcgtggncgacacggccctggacaaggacttggagttggagtggggatgggatcaggcgattacaattcggttaacactaaactntagacaacaacgaaactccgagggcaagacgtcacctanacgaccanacgacactacncccaagcgacacgtacgcctacgatagggatacggngggaacggtacgtccaggacgtaacgtccgtagaacgccgaaccgggttccgtagttaaagttcgtggttacggcgaggacggtccttaggccgttagggttcccggggacccgttccggaaccccggtgggggaccctaacgggttaacccgtcggg

SEQ ID NO: 317424 - DNA, 641 bp, Homo sapiens
  misc_feature: GZ8MTXP01CUFQC.21.61.F06.1.454.CMB.2.raw
  modified_base (297)..(297): a, c, t, g, unknown or other
  misc_feature (297)..(297): n is a, c, g, or t
  modified_base (458)..(458): a, c, t, g, unknown or other
  misc_feature (458)..(458): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagctggaggtagaagaacgccgtggggcctcgagtggaaggtcctccgtgactaaggtctttcgtcggtttaccacctttacagtactaataatagtcggctgggncgacacggcccctaggacaaggtcttggagtggagtgggatggatcgagtacgtacttaacgaagttacggttaaacaactaaaacttatacggacaacgaaggaaaccctaccgaagggcaagacgtaccaaccagtacgaaccacaacgacaacctacnccaacgacacaaccaacgcctaagacgtagggacgccgtaggggaacggagtaccgtaggaacgtagtccggtacgaaccgacgtaccggtaccgtagtaacgttcgtagttcggacgagacggtcttaagcgttacggtcggtcccggtcgacccgggtcgggccgtaacgggaaccgtccg

SEQ ID NO: 317425 - DNA, 647 bp, Homo sapiens
  misc_feature: GZ8MTXP01CAQMT.21.61.F06.1.454.CMB.2.raw
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
  modified_base (392)..(392): a, c, t, g, unknown or other
  misc_feature (392)..(392): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggcctnagtgagtctctgcaagcttctggttcaccttacagtctataatntcggctggtgcgacacggccctggacaaggcttgagtggatgggatggatcgagtcggtcttaacgaagttcggttaacactaaactactgacaacaagaaacctcgaagggcagaagtccacatacaccanacgaacacactacacgagacaacacaccgtaacgacgtagggacgtaccgtaggggaacggtacgccgtagggaactagtccgtaggaaaccgtaccggtacccggggtacggttacgttaagttaaccgtgggttcggaaccggttaggtacggggtacttacggggccgttacgggttccccggggccccggggtttccccggaccccgggttacgggggacccggtaacccgggttaacccggttcccgggg

SEQ ID NO: 317426 - DNA, 653 bp, Homo sapiens
  misc_feature: GZ8MTXP01CAT7T.21.61.F06.1.454.CMB.2.raw
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctgagtgaaggtctctgcaaggcttctggtttcactttaccagtctataatatcggctggngacgacacggccctaggacaaggtacttgagtggagtgggatggatcgagtcgtacttaacgaagttcggttaacaacgtaaactatacggacgaacaaacgtaaacctacccgaagggcaaggaacgtaccaaccgtagtaccgaaccaacacgaacacaacaccgaacgacgacacacgacctacgggggatacggacgacgtacggggaggacgaccgtaggaacgtagtaccgtacggaaccgacgtaccgggtaccgttagttacgttaacgtggttacggacggaggtacggtcgttacggcgttacgggtccgggtccccggtcccgggaccccggtcggggttacccggaaccgggttaacccgtccgg

SEQ ID NO: 317427 - DNA, 658 bp, Homo sapiens
  misc_feature: GZ8MTXP01AZQCK.21.61.F06.1.454.CMB.2.raw
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggngcgacacggccctggacaggcttgagtggatgggatggatcgagtcgtacttaacgaagttggtaacaactaaactactagacacaagaaacctccgagggcagacgtacacatcgacacacgacacactcccgagacgaccaacacgacctaacgagtagggaacgtccgagggggaacgggacgtaccgtaggaacgtacgttacgtaccggaaacccggtaccgaacccgggggttcgttaacgtttaacttaaccggtggttaggaccggaaggtacggttacttacgggcgttaccggggttccggggacccccgggtttaaccggacccccggggttagggggacccccgtaacgggggttaacccccgttcgggg

SEQ ID NO: 317428 - DNA, 651 bp, Homo sapiens
  misc_feature: GZ8MTXP01BWH8C.21.61.F06.1.454.CMB.2.raw
  modified_base (286)..(286): a, c, t, g, unknown or other
  misc_feature (286)..(286): n is a, c, g, or t
  modified_base (450)..(450): a, c, t, g, unknown or other
  misc_feature (450)..(450): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtggaagaagccgtggggcctcgagtgaagtctctgcaaggtcttcgtggtttcctacctttacagtctaataatagtcggcgtgggngcgacacggcccctaggacaaggtcttggagtggagtgggatggatcgagcgtacttagaattggttaaacacgtaaactatagacaacgaaacgaaacctaaccgaagggcaaggtaacgtaccaaacccgtatacggaaacccaacgaacgaaccaacaacncccaaaggacaccaacacgtacctaacgagtggaagccgtagggaaacgggcgtaccgtagaacgtagttccgagaaaccggactaccggggtccttaggtattaacgtggttaggacgttagggaacggtcgttaaggcgttacgggtcggtccccgggttcgaccccgggtcggggaccgtaacgggaaccgtcccggg

SEQ ID NO: 317429 - DNA, 642 bp, Homo sapiens
  misc_feature: GZ8MTXP01DYEGG.21.61.F06.1.454.CMB.2.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctcgagtgaaggtctcctgcaaggtcttctggtttcacctttacagtctaatatagtcggctgggncgacgacggccctggacaaggcttgagtggatgggatggatcgagcgtattacagttgtaacaacgtaaacttncgacaacaacgaacctccgaagggcagtacgtaccaaccatacgaaccanacgacactacacccgaagacgacacacgaccctagaagtgggaactcggtaggggaacgggacgtaccgtaggtaagacgttccgacggaaacccggccgtaccgggtaccgttagttacgttaacgttggcggacggttaaggtcggtacgtttacggcgttacggggttcccgggtaccccgggttcccgaccccgggtgggggaccccgtaacggggttaaccccgttcgggg

SEQ ID NO: 317430 - DNA, 689 bp, Homo sapiens
  misc_feature: GZ8MTXP01DA6X5.21.61.F06.1.454.CMB.2.raw
  modified_base (217)..(217): a, c, t, g, unknown or other
  misc_feature (217)..(217): n is a, c, g, or t
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctctgcaaggtcttctggtttccacctttaccagtctaataatatcggctgggtncgacacggcccctggacaaggcttgagtggatgggatggatcgagtcgtactaacgaattcggttaacaaactaaaacttatcggactaacgaaacgaaaacctcccgaaggggccaaggtacgtaccaccatacgaacccaacgaagaccaactacaccaacggaacacaaccacgcctaacgagtcgggaagccgtagggggaacggacgtacccgtaggaacgtaacgtccgtacggaaacccgccgtaaccggggtccgttaggttaaactttaacggtgggttacggtaccggaggtacgggtctttaaagggccgttacgggggttaacccgggtaccccgggtttccggacccccggggttagggggacccctaaccgggggttaaaccccgtttccgggg

SEQ ID NO: 317431 - DNA, 728 bp, Homo sapiens
  misc_feature: GZ8MTXP01AOLK7.21.61.F06.1.454.CMB.2.raw
  modified_base (219)..(219): a, c, t, g, unknown or other
  misc_feature (219)..(219): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtagaagagccgtggggcctnagtgaaggtctcctgcaaggtctttcgtggtttcctacctttaccagtactataatagtcggtcgtgggtcgacgaccgacggcccctaggacgaaggcttggagtggagtgggatggatcgaggtctacttaacgaagttacggttaacaaactaaactacgtacgacaaacgaaacgtaaaccgtaccgaagggccaaggtaccgtaccaaccgtagtacgaaacccaacaacgacacgactaccgaacgacacacacgtacctagagtacggacgtaccgtaggggaacggacgtccgtaaggacgtaacgtcgtaacggaacccggaacgtacccggggtacgttaacgttacgttaaggtcggttaaggtcgggttaacgggtacgggttacgtttaccgggcggttaacccggggttcccgggggttacccccgggttaacccggaccccgggggtaccgggggttaccccggtaacccgggggttaaccccgtttcccgggg

SEQ ID NO: 317432 - DNA, 671 bp, Homo sapiens
  misc_feature: GZ8MTXP01C7DW0.21.61.F06.1.454.CMB.2.raw
  modified_base (471)..(471): a, c, t, g, unknown or other
  misc_feature (471)..(471): n is a, c, g, or t
  modified_base (510)..(510): a, c, t, g, unknown or other
  misc_feature (510)..(510): n is a, c, g, or t
  modified_base (533)..(533): a, c, t, g, unknown or other
  misc_feature (533)..(533): n is a, c, g, or t
  modified_base (643)..(643): a, c, t, g, unknown or other
  misc_feature (643)..(643): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtcgcccactcccaggttcagatgatgcagtctggagctgaggtagaagagccgtgggcctgagtgaagtctcctgactaaggtcttcgttcggtttacctacctttaccgagtacttaataactacgtcggtcgtgggtcgaccgacgacggtccccgtaggaccgaaggtactttggaaggtggagtggggtataggactacggacgtcgttaaccttaagtaaagttacggtaaaccaaacgtaaactgtacgacaacgtaacgaaacccgtccggaggaacaacggtacaccgaacagacgaacaacganacacactacgacacgacaacgtcaccctagagtcggacncgtacgggacgcgtacgtagacncgtcgacgaacgaccgtcgtacccgttagttaacgttaacggtgacgggttagaacggtacgtacgttacggcggttacggttcccgggtacccgttccggaccccgggngggaaccccgtcggttaacccgttccgg

SEQ ID NO: 317433 - DNA, 635 bp, Homo sapiens
  misc_feature: GZ8MTXP01BKG0U.21.61.F06.1.454.CMB.2.raw
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagctggggcctnagtgaagtctcctgcaaggcttctggttcactttacagtctataatatcggctgggtncgacncggccctaggacaaggacttggagtggagtgggatggatcgagcgtacttaacaattggtaacaacaaactactgacaacaacgaaacctccgaagggcaagtacgtaccaaccgaatacggaaaccaacaagaaccaacacaccgaacgacgaccaacaacgccctaaacagacggaactcgaggggacggtagcctagggaactaagtccgtagaaccgtaccgaacgggtccgttacgtaaattcgtggcgacgttaggtaacggtcttaaggcgttaacggggttccccgggtcccgggttaacccggcccggtacgggggaccccgaaccggggttaacccgttcccgggg

SEQ ID NO: 317434 - DNA, 629 bp, Homo sapiens
  misc_feature: GZ8MTXP01ENZFM.21.61.F06.1.454.CMB.2.raw
  modified_base (276)..(276): a, c, t, g, unknown or other
  misc_feature (276)..(276): n is a, c, g, or t
  modified_base (510)..(510): a, c, t, g, unknown or other
  misc_feature (510)..(510): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggttcacctttaccagctataatatcggctgggncgacgacggcccctggacaaggcttgagtggatggggatggatcgagcgtacttaacgaattcggttaaacaactaaaactatacggacaacaaacgaaaacctcccgaaaggggccaagaacgtaccaaccgaatacgaaaccaacagacaacacgaaccacggacgtaccaacgaacgaccctaacaagtagggaacgtcgtaggggaaacgggacgtccgtaggacgtacnccgtaggaaccgacgaccggtcgtagtagttaacgtaggttgacgaggcgtacgttaggcgttagggtccggtcccggttccggccccggtggggaccgtaacggttaaccccgtcggg

SEQ ID NO: 317435 - DNA, 621 bp, Homo sapiens
  misc_feature: GZ8MTXP01CQV9V.21.61.F06.1.454.CMB.2.raw
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
  modified_base (518)..(518): a, c, t, g, unknown or other
  misc_feature (518)..(518): n is a, c, g, or t
  modified_base (567)..(567): a, c, t, g, unknown or other
  misc_feature (567)..(567): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctgagtgaagtctctgcaggtcttcgtgttcctacttaccagtctataatagtcggctgggcgcgacacggccctaggacaaggcttgagtggatggggatggatcgagcgtactaacgtagttacggttaaacaactaaaacgttntacgacaacgaacgaaaccgtaccgaagggctagaacgtacaaccgatacgaacccaanacgaacaacaacaccgaacgaacgactaaaccgacgaaccctaacagtcgggaactaccggtaggggaacgggaacgtcctaggaacgttactacgnggaaacccgtccgtaacggtccgtattacgtcgtggacgtgagtacgtnttacggcgacggtccgggcccgttcgcccgggtggacccgtaacgggcccgtgg

SEQ ID NO: 317436 - DNA, 661 bp, Homo sapiens
  misc_feature: GZ8MTXP01DUCEX.21.61.F06.1.454.CMB.2.raw
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggtcttctggtttcacctttacagtctataatatcggntggtncgacnggccctggacaaggcttgagtggatgggatggatnagcgtacttaacgtaattcggttaaacagtaaacctatgacaacaagaaacctacccgagggcaagacgtaccacctaatcgaaccaacaagaccaacacgtaccaacgagaccaactacgaccctaacgagtacgggagtccgtagggggaacgggacgtacccgtaggaaacgtaccgttacggacggaaacccggaccgtaaccggggtaccttaggttaaccgttaacgtgggttcggtacggaacgtacgggtctttaaggccgttaacgggtcccggtacccgggttcccggaccccgggtggggttacccgtaaccggggttaaccccgtttccggg

SEQ ID NO: 317437 - DNA, 693 bp, Homo sapiens
  misc_feature: GZ8MTXP01BC5I6.21.61.F06.1.454.CMB.2.raw
  modified_base (281)..(281): a, c, t, g, unknown or other
  misc_feature (281)..(281): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctcgagtgaaggtctcctgcaaggcttctggttcacctttacagtctataactagtcggctgggngcgacgacggcccctggacaaggtacttggagtggagtggggatggatcgaggtcgtacgtttaacgaagttacggttaacaacgaaacttacgtacggacaacgtaaacgaaaacccgtaccgaacggggcaaaggaacgtacccaacccgaatacggaaacccacgaacgaacaaccaanaccccgaagagtacccacacgaccctaanagtacggaacgtccgtaggggacggacgacccgttaggaacggcttcgagaacccgacggtaacccggtcgttacgttaacgtttaaccggtggttacggacggttagtacgggtacttacggttccggttacgggtcccgggtaccccggttaaccgaccccggggtacggggttacccgtaaccgggttaacccgtccg

SEQ ID NO: 317438 - DNA, 643 bp, Homo sapiens
  misc_feature: GZ8MTXP01A3LMS.21.61.F06.1.454.CMB.2.raw
  modified_base (443)..(443): a, c, t, g, unknown or other
  misc_feature (443)..(443): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcaccttttaccagtctataatagtcggctggcgcgacacggcccctggacaaggcttgaggtgagtgggatggactcgagcgtacttaacgaagttcggttaacaacgtaaactactacgacaaccgaagaaacctacccggaagggcaaagggacgttaccacccgaagtacgaaccaacgacgacctaacaacnccgaacgacgaccaacacgacctaacgagtggaacgtccgagggaacggacgccgtaggaacgctcgtacgaccgacgccggtaccgttaggttactcgtagttcggaacgaggtacggtcgttaacgcgaacgggtttcccgggaccccggtttccgaaccccgggttgggaccccgtaacggggttaaccccgtcggg

SEQ ID NO: 317439 - DNA, 617 bp, Homo sapiens
  misc_feature: GZ8MTXP01BD35L.21.61.F06.1.454.CMB.2.raw
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttacagctataatatcggctgggtgcgacacggcccctggacaaggacttgagtggagtgggatggatcaggcgtactacgaagtggttacaacaaactatggacacgaacgaaaccgtccgaaggggcaaggacgtcaaaaccntacgaaccacaagacaactanacccaagacgcaacgagtaccctaacagtacgggaagtccgtagggggacggaacgccgtaggaacggtaatccctagggaccgacgaccgggtccgtaggttacttaacgtgacggtcgaggaacgggtcttaggccgaggttcccggggccccggttcggaccccggtcgggggacctaacggggttaacccgtcggg

SEQ ID NO: 317440 - DNA, 549 bp, Homo sapiens
  misc_feature: GZ8MTXP01COOGO.21.61.F06.1.454.CMB.2.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (469)..(469): a, c, t, g, unknown or other
  misc_feature (469)..(469): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttctggtggcagcagcaacaggtgcccactcccaggttcagatgatgcagtctggagctgaggtgaagaagcctggggcctnagtgaaggtctcctgcaaggcttctggtttcactttaccagtctataatatcggntgggngcgaacnggcccctggaccaaggacttgagtgatgggatgancgagcgtntaacagtggtaacacaaactatcgaacacgaanaaacgtcgaacgggnaagactacacanacgaccacacacactacacagacacacacaccagagngacngaggacgngtcgagacagtcgacgacgcgtcgtcgtatatgngttgacgaggacgtcttacgcgttacggtccggtacccggtccggcccggtacgggttacccgtaaccggttaaccgtcg

SEQ ID NO: 317441 - DNA, 620 bp, Homo sapiens
  misc_feature: GZ8MTXP01ADB6W.21.61.F06.1.454.CMB.2.raw
  modified_base (280)..(280): a, c, t, g, unknown or other
  misc_feature (280)..(280): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcacctttacagtctataatatcggctgggtncgacacggccctggacaggcttgagtggatgggatggatcgagcgtacttacaagttggttaacaactaaactatcgacaacgaacgaaacctccgaagggcagacgtcaccgatcgaaccacacgaacctaacacacccgacgagaccaacgtacgaccctaacgagtacgggacgtcgaggggaggacgccgtaggaaacgtcttcgaggaccgtaccgaccggtccgttagtacttcgtggttcgacgaggcggtcgttacggcgttacgggtcccgggtcccggttcccgggaaccccgggtgggggacccgtaaccggggttaaccccgttcggg

SEQ ID NO: 317442 - DNA, 699 bp, Homo sapiens
  misc_feature: GZ8MTXP01BA0R7.21.61.F06.1.454.CMB.2.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (493)..(493): a, c, t, g, unknown or other
  misc_feature (493)..(493): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctcgagtgaggtctcctgcaaggtcttcgtggtttctaccttacagtactatatagtcggngtggngcgacgcggccctaggactaaggtcgttggagtggagtgggagtggatcgacgccgtacgttaacgtaagttcggttaaacaaacgtaaactacgtacgaacaacgtaaacgaaaccgtaccgaagggcaaggtaccgtaccaccgtactacgaaccacgaccgaacacctaaccgaccaaacggacgaacccaaacgtaacgacccgtaaanacggttacgggactaccgggtaaggggacggggtacctccgtaaggacgtaaccgttcgacggaaaccgtcgtacccggtcgtttagtacgttaacgtggacgggacgttacgggtacgtcggttaacgccgggttacggggtcccggtccccggggtaaccggaccccgggggtgggaccccgtaaccggggttaaccgtcccgg

SEQ ID NO: 317443 - DNA, 683 bp, Homo sapiens
  misc_feature: GZ8MTXP01ALSK9.21.61.F06.1.454.CMB.2.raw
  modified_base (192)..(192): a, c, t, g, unknown or other
  misc_feature (192)..(192): n is a, c, g, or t
  modified_base (275)..(275): a, c, t, g, unknown or other
  misc_feature (275)..(275): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagagccgtgggcctgagtgagtctctgcaggtcttcgtgtttccacctttacagtctatatagtcggctgggcncgacgacggcccgtaggaacgaaggtcttggaggtggagtgggatggatcgagtcgtacttaacgtagttacggtaacaacgtaaactcgtacgacaacgaacgaaaccgtacccgagggtcaagacgtaccaaccagtacgaaaccaacacgaaccaactacgacccgaaacgacgaccaacacgacctaagagtacggacgtacggaggggtaacggaccgttccgaggaaccgtcgttacccgacggaacccggtaccggtaccgggttaccgtttaacgttacgttaacggtggttacggacggaggtacggttacgttacggacggttacgggttccccggggtaccccggttcccggaaccccggggttcggggaccccggtaacgggttccccgttccggg

SEQ ID NO: 317444 - DNA, 623 bp, Homo sapiens
  misc_feature: GZ8MTXP01A5F11.21.61.F06.1.454.CMB.2.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagtctataatntcggctgggncgacncggccctggacaggacttgagtggatgggatggatcgagtcgcttagattggttaacataaactgtcgactaacgtaagaaacctccgaagggtcaacggacgttaccaacctagtcgaacctacgaacgtacaacaactccgaagtacgacctaacgacggtcctaacgtactgggacgtcgtaggggacggtaacggtcctaaggacgtacgtcgtacggaaccgtacgtaccgggtcgttaagtacttaacggtgttaggcggaggtacgtcgttacgcgttagggtccggtccccggtaacgccccggttggggaccctaaggggaacccccttggg

SEQ ID NO: 317445 - DNA, 706 bp, Homo sapiens
  misc_feature: GZ8MTXP01C7OP3.21.61.F06.1.454.CMB.2.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgcaaggcttcgtggtttcacctttacagtctataatagtcggctgggtncgacgaggcccctggacaaggcttgagtggagtgggatggatcgagtccgtacttaacgaagttcggttaaccaactaaaacttacgtacgaacaacgaaacgtaaaaccctcccggaagggaacccgaaagtaaccgttaacccaaaccccgtaagttaccggaaaccccaaacgaacgaaaccaaccgtaaacgtaccccgaaccggaaacgacctaaccgacggaccccttaacgagtagggaacgccgttagggggaaacggtacgtccgtagaacgacgtcgtacggaaaccgacgtaaccggtaccgttagttaagttaacgtggttggacggagtacggtcgttaacgcgttaacgggtcccggtaacccggttccgacccgggttcgggacccgtaacggggttaaccccgttcggg

SEQ ID NO: 317446 - DNA, 640 bp, Homo sapiens
  misc_feature: GZ8MTXP01B9I3X.21.61.F06.1.454.CMB.2.raw
  modified_base (274)..(274): a, c, t, g, unknown or other
  misc_feature (274)..(274): n is a, c, g, or t
  modified_base (403)..(403): a, c, t, g, unknown or other
  misc_feature (403)..(403): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
  modified_base (527)..(527): a, c, t, g, unknown or other
  misc_feature (527)..(527): n is a, c, g, or t
tcagtcgtcgctcgcacgaccggtgctcgatttagctacgctctaaggggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctctgcaaggcttctggttcacctttacagctatatatcggctgggncgacaggccctggacaaggcttgagtggagtgggatggatcgagcgtattacaagtggttaacacgtaaactatgactaacgaacgaaacctaccgaagggcaaggtacgtaccaaccatacgaaccanaacgacaacactcccaacgacgtacaaccagaccctaacgagtcgggaanccgtaagggggacggtaagcccgtaggaacgnttaccggagaaccggtacgacgggtccgtagttacttaacgngttaggaccggttagtacggtcgttacggcgttacggggtcccgggtccccgggtttaaccggaaccccgggttggggggaccccgtaaccgggggttaaccccgttccgggg

SEQ ID NO: 317447 - DNA, 816 bp, Homo sapiens
  misc_feature: GZ8MTXP01C7D01.21.61.F06.1.454.CMB.2.raw
tcagtcgtcgctcgcacgaccggtgctcgattttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagctgaggtagaagaagccgtggggcctgagtgaaggtctcctgacaaggtcttctggtttctacctttaccagtacttaataatagtcggctagggcacgacgacggacccctaggaaccaaggtacttggagtggatgggatggatcgagtctactaacagttacgtaaacaactaaacttagacgacaacgaaacgaaaaccgttccggaaacgggaactaaacgggaacgttaacccgaaacctaacgtaccggaaacccaaaccggaaacgttaaccaaacctaaccggtaacccaaacgggaaacccgacccgttaaaccacggaaacccccttaaagaaccgggtaggggaacctacggttaagggggaaacggggttacgaccgtaaggggaaacttaacggtcccgtaaacgggtaaacccggaaccgtaccgggggttaacccttttaagggttaaactttaaccgggtaggttacccgggaacgttaaggggtaacccggtacgtttaagggcccgttaccgggggtaacccgggggtacccccgtttaaccggggaacccccggggttcggggaacccgggttaacccgggggttaacccctttaaccgggg

SEQ ID NO: 317448 - DNA, 668 bp, Homo sapiens
  misc_feature: GZ8MTXP01EJSNP.21.61.F06.1.454.CMB.2.raw
  modified_base (275)..(275): a, c, t, g, unknown or other
  misc_feature (275)..(275): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctctgcaggtcttctgtttcacttacagtctataatatcggcgtgggngcgacgacggccctggacaaggtacttggaggtggagtggggatggatcgagcgtacttaacgaagttacggttaaacaaactaaacttaacgtcgacaacgaacgaaaacccgtccgaagggcaagacgtaccaaccatacgaacccaaacgacgaacacaactccaacggacacacaacgcctaagacgtagggacgtccgtagggggaacggtacgacccgtaggaacgtacgtaccgtacgggaaaccggtaccgtaccgggtaccgttaggttaacttaacggtggttcggacggttaaggtacggtcgttacggcggttacgggtcccgggtaccccggtccgggaccccggtcgggggaccctaaccggggttaaccccgttcggg

SEQ ID NO: 317449 - DNA, 673 bp, Homo sapiens
  misc_feature: GZ8MTXP01CEYJM.21.61.F06.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagccgtggggcctnagtgaaggtctcctgctaaggtcttcgtggtttccacctttaccagtactataatatcggctgggncgacacggccctggacaaggcttgagtggagtgggatggatcgagtcgtacttanaagttcggttaaacaacgtaaaactactacggactaaacgaacgtaaacctacccgaagggcaagacgtaccaacacgtacgaaccaacaacgacaacacgtacccaacgagaccaacgacaccctaagaacgtcggaaagtccgtagggggaacggtacgtccgtaaggacgtactcgtaacggaaccggtaaccgtaccgggtaccgttaggttaacttaaccggtggttacggcgaaggtaacggttcgttaaacggcgttacggggttcccgggtaccccggttcggacccccggtgggggaccccgtaaaccggggttccccgttcggg

SEQ ID NO: 317450 - DNA, 626 bp, Homo sapiens
  misc_feature: GZ8MTXP01DSSEI.21.61.F06.1.454.CMB.2.raw
  modified_base (272)..(272): a, c, t, g, unknown or other
  misc_feature (272)..(272): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctggggcctcagtgaaggtctcctgcaaggtcttctggtttcacctttacagtctataatatcggntgggtgcgacacggccctggacaaggacttgagtggatgggatggatcgagcgtcttaacaagttcggttaacaactaaactatacgacaaacgaagaaacctaccgaagggaacagaacgtacaccaatcgaaccacagaacacacgaccaganacactacgcctaagagtcggagtcgtagggacggagcctagaagctcgtaggaaaccgtacgacgggtaccgttgtaattaacgtggttacggacggttagtacggtacgttacggcgttacgggttcccgggggaccccggtttccggaacccccgggttcgggggacccggtaaccggggttaaccccgttccgggg

SEQ ID NO: 317451 - DNA, 727 bp, Homo sapiens
  misc_feature: GZ8MTXP01DEHMZ.21.61.F06.1.454.CMB.2.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (483)..(483): a, c, t, g, unknown or other
  misc_feature (483)..(483): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtcgcccactcccaggttcagatgatgcagtctggagctgaggtagaagagccgtgggcctnagtgaagtctctgacaggtcttcgtggtttcctacctttaccagtacttaataatagtcggcgtgggnccgacgacggccctaggacaaggcttgagtggatggatggatcgagtcgacttaacgattacggttaaacaacgtaaactgtacgacaagaaacgaaaccgtacgaacgggcaaagtacgtaaccaactacgacgaaaccaacgaacaaccaacgacaacccgaagacgaaccttaaacgacgtaccccgtaaagnggtaacggaacgtacggtaacgggggaacggtacggtaccgtaaggaaccgtacgtaccggtaacggaacccggtaacccggtaccgggttacgtttaacgttaacggttaacggtggttacggaacgggttacggtaaccggttacgttacgggccggttaccggggttccccgggtaccccgggttaaccccgggaccggggtaccgggggttacccgttaacccggggaaccccgttccgg

SEQ ID NO: 317452 - DNA, 739 bp, Homo sapiens
  misc_feature: GZ8MTXP01BJCIN.21.61.F06.1.454.CMB.2.raw
  modified_base (192)..(192): a, c, t, g, unknown or other
  misc_feature (192)..(192): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctggggcctcgagtgaaggtctcctgcaaggtcttcgtggtttcctacctttaccagtactataatgtcggtcgtagggtcgcggaacgacgggccccctagggaacctaagggtactttggaaggttgggagtggggataggaattccgaggtccgtactttaacgaagttacggttaaacaaacgtaaaactacgtacggacaacgaaacgtaaaccctacccgggaagggcaaggtaacgtaccaccgtaagtaccgaaccaacgaacgtacaacctactacccgaacggacaacctaacgaccgacctaacgacgtcgggaagccggttaagggggaacggtaacgcccggttaaggaaacgtaccgttacgacggaaacccggaaccgtccggggtacccgttagttaacgttaacgtgggacgacggttaggtacggtacttacgggcgttaacggggtcccgggcccccgggtttaacggcccccgggtgggggaacccgtaacccgggggttaacccgtccggg

SEQ ID NO: 317453 - DNA, 657 bp, Homo sapiens
  misc_feature: GZ8MTXP01A8LM8.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctcctgcaaggcttctggttcacctttaccagtctataatagtcggtctgggtcgcgacgaggcccctggacaaggcttgagtggagtgggatggatcgagcgtacttacgaagttggttaacaacgtaaactagtcgacaacaagaaacctaccgagggcaggaacgtccactacgtacgaaccacaacgtaccaactacgacccaacgacgaccaacgactacccgtacacgtagggagtaccgtaggggaacggagtacccgtgaacgtaacgtcgtaacggaacccggacgtacccgggtacccgttagttaacgttaaccgtgggccgtaggaagtacgggtcttaacggccgttagggtccccgggtccccggttaaccgaccccgggtcgggggaccctaaccggggttaaccccgtccggg

SEQ ID NO: 317454 - DNA, 695 bp, Homo sapiens
  misc_feature: GZ8MTXP01AS5WW.21.61.F06.1.454.CMB.2.raw
  modified_base (344)..(344): a, c, t, g, unknown or other
  misc_feature (344)..(344): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttcgtgtttcacctttaccagtctataatagtcggctgggcgcgacgacggcccctaggacaaggtacttggagtggagtgggatggatcgagtcgtacttaanaagttggttaacaactaaaactatacgacaacgaaacgaacctaaccgagggcaagacgtacaccagtacgaaccaacacgaacaacactacccgaaacgacgtaccaacacgtaccctaagagtacggaagtccgtagggggaacggtacgtcccgtaaggaacgtacgttccgtacggaaccgtaccgtaaccggggttaccgttagttaacgtttaacggaggttacgggaccgaaagggtaccggtacgtttaacgggccggttaaccggggttcccggggtaccccgggttaaccggacccccggggttgggggaccccggtaaccggggttaacccccgttcggg

SEQ ID NO: 317455 - DNA, 626 bp, Homo sapiens
  misc_feature: GZ8MTXP01D35EQ.21.61.F06.1.454.CMB.2.raw
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctgagtgaaggtctctgcaaggtcttctggtttcacctttaccagtactataatgtcggcgtgggngacgacgacggccccgtaggacaaggtacttggaggtggagtgggatggatcgagcgtactaacagttacgtaacaacgtaaactagtacgacaacgaacgtaaaccgtacccgaagggccaagtaacgtaccaacagtacgaaccaagacgaacactacaccgaagacgaccacacgacctaacgagtgggaacgtcgaggggaaacgcgtacctaggaatacgtcgacggacgtaccgtaccggtacgttagtacgttaacgtggacggtagaggtcgtacgttacgcgttacggtccgggcccgttcgacccggtgggacccgtaacgggttaacccgtcgg

SEQ ID NO: 317456 - DNA, 707 bp, Homo sapiens
  misc_feature: GZ8MTXP01A2R0V.21.61.F06.1.454.CMB.2.raw
  modified_base (273)..(273): a, c, t, g, unknown or other
  misc_feature (273)..(273): n is a, c, g, or t
  modified_base (543)..(543): a, c, t, g, unknown or other
  misc_feature (543)..(543): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagctgaggtgaagagctgggcctgagtgagtctctgcaaggcttctgttcacctttaccagtctataatagtcggcgtgggngacgacacggcccctggaaccaaggtcttaggaggtggatgggggattgggatcgaggtccgtacgtttaacaagttcggttaaacaactaaaacgtataggaccaaacgtaacgtaaacccgtcccggaaagggcctaaagtaccgtacccaaaccgtagaaccggaaacccaaacgaccgaaccaactacgtacccgaaacggacgaacctacgaaccggttacccaagagtacgggaatccgtaggggaacggagtccctagggaancgtcgaacggaccgtaccgtcgggttccttaagtacgttaacgcggacgtacggttaggacggttcgttacggcggttaccgggttccccggggtacccccgggtttaacccgggaccccggggtacggggttaaccccggtaaccgggtttaacccggtccgg

SEQ ID NO: 317457 - DNA, 678 bp, Homo sapiens
  misc_feature: GZ8MTXP01CSG98.21.61.F06.1.454.CMB.2.raw
  modified_base (580)..(580): a, c, t, g, unknown or other
  misc_feature (580)..(580): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagcgtgaggtagaaggaacggccgtggggcctacgaggtaggaacggttcctccgtgacgtaaggtctttcgttcggtttacctacctttaccagtactaattaatacgtcggcgtgggcgacgacgacggacccctaggaacgaaggtacttggagtggagtgggatggatcgagtcgtactaacgagtacgtaacaactaaactacacgacaacgaacgaaccgtaccgaagggcaagactaccgaactacgacgaccaacaacgacaacacaccaacgacgacaaccacgaccctaagagtcggaactcggtaggggaacggacgtaccgtaggaagtaccgtcgacggaaccgtacgtacccgggtacttacgttacgttaacgnggttacgacggagtacggttacttacgggccgttaccgggtcccggtaccccgggtccggtaccccggtggggacccgtaacgggttaaccccgtcgg

SEQ ID NO: 317458 - DNA, 752 bp, Homo sapiens
  misc_feature: GZ8MTXP01EVZUZ.21.61.F06.1.454.CMB.2.raw
  modified_base (291)..(291): a, c, t, g, unknown or other
  misc_feature (291)..(291): n is a, c, g, or t
  modified_base (466)..(466): a, c, t, g, unknown or other
  misc_feature (466)..(466): n is a, c, g, or t
  modified_base (490)..(490): a, c, t, g, unknown or other
  misc_feature (490)..(490): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgccccactcccaggttcagatgatgcagtctggagctgaggtgaagagccgtggggcctcgagtgaacggtctccgtgcaaggtcttcgtggtttaccacctttaccagtactaataagtagtcggactgggncgacgacggtcccctaggaacaagggtcttaggagtagggagtgggggatagggacttacgagtccgttacgtttaacgaaaggttcggttaaaccaaactaaacgtatacggacaacgtaacgaaaccgtacccgaagggcctaagaccgtacaacctaagtacggaaccctanaacgacaacgtacacccgaagganacccaacgtaacggtacccctaagacggttacggaaacgtcccgttaagggggggaacgggttaaccgacccgttaaggggaactaacgttcccggaaacggtaaacccgggtaccgtaccggggttaccgtttagtaccgtttaaggcggttacggacgggttaggtacggttacgttacggcgttaccggggtccgggtccccggttaaccgggccccggtcgggggttaacccctaacgggggttaacccgttcccggg

SEQ ID NO: 317459 - DNA, 666 bp, Homo sapiens
  misc_feature: GZ8MTXP01BKYKJ.21.61.F06.1.454.CMB.2.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (585)..(585): a, c, t, g, unknown or other
  misc_feature (585)..(585): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctcgtgcaaggtcttcgtggtttacctacctttacagtactatatagtcggntggncgacgacggccctaggactaaggacttgaggtggagtgggagtggatcgagtcgtacttagaagttacgttaacaactaaacgtagtacgacaacgaacgtaaaccgtaccggaagggcgaagtacgtaccaaccgtagtaccgaaccgaacacgtaacacctaacaccgaacggaacaacccgacaacgtaccctaagacggtaggaacgtcgtaggggaacggcgtacgaggtacgacttccggagaaccggaccgtaccgggtcgttaggtacttaacggtgttcggacgttaacggngtaacgttggccggttacgggtcccgggtacccgggttaaccggcccgggacggggaacccggtaaccgggttcccgtcgg

SEQ ID NO: 317460 - DNA, 665 bp, Homo sapiens
  misc_feature: GZ8MTXP01CGJ3Y.21.61.F06.1.454.CMB.2.raw
  modified_base (278)..(278): a, c, t, g, unknown or other
  misc_feature (278)..(278): n is a, c, g, or t
  modified_base (325)..(325): a, c, t, g, unknown or other
  misc_feature (325)..(325): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttcgtggtttcacctttacagtctatatatcggctgggtncgacaggcccctggacaggacttgagtggatgggatggatgagcgtnttacaagttcggttaacaactaaactatacgacaacgtaacgaaaccttcccgaaggggcaaagggaacgtaccaacccgaagtacgaaaccacgacacaacactacccgaagacgacaacgtacgcctaacagtggagtacgtaggggaacgggacgtacccgtaggaaacgtcgtaccgttacggaaacccgtcggaaaccgggttccggttaagttaacgtttaacggtggttaggtaccggaggtaacggtcgtttacggccgttaggtcccgggtaccccgggtttcggacccccggggtggggttaccccgaacggggttaaccccgttccggg

SEQ ID NO: 317461 - DNA, 608 bp, Homo sapiens
  misc_feature: GZ8MTXP01C0D9E.21.61.F06.1.454.CMB.2.raw
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctgttcacctttaccagctataactatcggctgggtncgactacggcccctaggacaaggcttgagtggatggggatggatcagcgntacatggttaacanaaactntgacanaagaactcccgaagggccaggataccaccgatcgaccacacgacactacncaaccgngaacactagaccctaanatcggaagtcgtaggggaacggacgaccgtaggaacgtacgtcgtacggaaaccgcgtaacccggggtcttaggtaaccttaaggtcgaggacgaggtacggtcttaacggccgttacggtcccgggtaccccggttcccggaccccgggtacgggacccgtaaccgggttaacccgtcgg

SEQ ID NO: 317462 - DNA, 656 bp, Homo sapiens
  misc_feature: GZ8MTXP01CMMEB.21.61.F06.1.454.CMB.2.raw
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
  modified_base (552)..(552): a, c, t, g, unknown or other
  misc_feature (552)..(552): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaagtctcctgcaaggcttctgtttcacctttacagctatatagtcggctggncgacacggccctggacaggcttgagtggagtgggatggatcgagtcgtacttacaattcggttaacactaaactntacgacaacaacgaaaccgtcccgaagggcaggtaaacgtaccaaccgagtaccgaaccacgaacgacaacactaccaacgacgaccaaccgacgaccctaagagtacgggagtacgtaggggacggtaacgccgtaggaacgcgttacgacgaaccggacgtaccgggtaccgttgttaacttaacggtgttgggaaccgnggtaacggtcgttacggcgttaacggggttcccggggtccccgggtttaacccggccccggggttacgggggaccccgtaaccgggggttaaccccgttccggg

SEQ ID NO: 317463 - DNA, 635 bp, Homo sapiens
  misc_feature: GZ8MTXP01DSU65.21.61.F06.1.454.CMB.2.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgcaaggtcttctggtttcacctttaccagtctatatagtcggctgggncgacacggccctggacaggcttgagtggatgggatggatcgagtcgtacttaacagttcggttaacacgtaaacttgcgacaacgaacgtaaacctcccggaagggtcaagtacgtaccaacctagtacgaaccacacgaacaacctacacccgaagacgaccaacgacgtacccctaagagtacggaacgtccgtaggggaacgggactaccgtaggagtactcgagaaccgacgtacggtccgttagttacgttaacgtgacggacgttagggtcgtcgttaacgcggttacggtccgggtccccggtaaccgccccgggtggggacccgtaaccgggttaacccgttccggg

SEQ ID NO: 317464 - DNA, 700 bp, Homo sapiens
  misc_feature: GZ8MTXP01AHK79.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttctggtggcagcagcaacaggtgcccactcccaggttcagatgatgcagtctggagctggaggtgaagagccgtgggcctgagtgaggtctcgtgactaggtcttcgtcggttcctaccgttacagtactaatatagtcggtcgtgggcgacgacgacggcccgtaggaacgaggtcttggaggtggtagtggggtatggctacgagtcgtacttaacgagttacgtaaccaataaactacgtacgactaacgaaacgtaaccgtcccggaacggcgtaaacgggtacctaacccgacgtaaccgtacgaaacccgtaacaaaccggacacctaaccgaccggaaacgacgacctaacgcccggtaacctaacgacgtagggaacgtcccggtaggggaacggacgtccgtaagggaacgtcgtcccggtaaggacccgggaccgttaccgggttcgttaccgttaggttaacgcggttaggggccttagggtcgtgttacggccgttacgggtccggtaccccggtcggcccgggtacgaccggtaaccgggttcccgtccggg

SEQ ID NO: 317465 - DNA, 689 bp, Homo sapiens
  misc_feature: GZ8MTXP01A6D23.21.61.F06.1.454.CMB.2.raw
  modified_base (480)..(480): a, c, t, g, unknown or other
  misc_feature (480)..(480): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctcctgacaaggtcttcgtggtttcacctttaccagtctaataatagtcggctgggtcgacgtacgacggcccctaggacaaggtactggagtggagtgggatggatcgagccgtacttaacgtaagttacggttaacaaactaaacgttacgacgacaaacgaaacggtaaacctcccggaagggcaaaggtaccgtaccgaaccgtaacgtacgaaaccaaacgaacgaacaaccgacaccgaaccgganaacccacgtacgacccttaagagtcggaacgtgtacggggaacgtacgtaccgtagggactaacgttaccgtaacggaccgtccggtacgttagttaactcggtgtggacgtacgggttacgtcgtaagttcggttacggttcccgggttaacccggtcccggtaacccggtcgggaacccgttacgggtaacccttcgggtaaccccg

SEQ ID NO: 317466 - DNA, 682 bp, Homo sapiens
  misc_feature: GZ8MTXP01AO85D.21.61.F06.1.454.CMB.2.raw
  modified_base (284)..(284): a, c, t, g, unknown or other
  misc_feature (284)..(284): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctccgtgcaaggtcttcgtggtttcacctttaccagtctataatagtcggctgggncgacacggcccctggacaggtcttgagtggagtgggatggatcgagcgtacttaacgaagttcggttaacaactaaaactactacggacaacgaacgaaacctcccgaaggggcaggaacgtaccaacccataccggaaaccaacgaacgaaccaacaactacccgaacggacaccgacaacgaccctaacaggtcgggaacgccgagggggaacggacgtaccgttaggaacggtacttaccggacggaaccggaccgtaccgggtccgttagttacgttaacgtggttacgggaccgaagggtacggtacttaacgggccgttacggggtcccgggtccccgggttaacccggtaccccgggtgggggaccccgtaacggggttaaccccgtcggg

SEQ ID NO: 317467 - DNA, 713 bp, Homo sapiens
  misc_feature: GZ8MTXP01A9DTY.21.61.F06.1.454.CMB.2.raw
  modified_base (272)..(272): a, c, t, g, unknown or other
  misc_feature (272)..(272): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaagtctctgcaggtcttctggttcacctttaccagactataatagtcggntgggtgcgacacggcccaggtacaggtacttggagtggagtgggatggatcgagtcgcttaacgagttgttaacacgtaaaactacgtacgacaacgaacgtaaaccgtaacccgagggtaaccaaggtaccgtacccaaccctaagtacgaaacccgaacaagtaacccaacgaactacccgaaaccgaacggaccctaacgaaccggtacccctaaagacgttccgggaagtccggtaaggggggaacggtacgtccgtaggaacggtactttaccgacggaaacccgggtaaccgtacccggggtcgtttacgttaaacgttccgtggttacgggaaccgagggtaaccgtcgtttacggccggttgggttaaccccggggccccggtttccgggaaccccgggtcgggggacccaaccggggttaacccgggtcccg

SEQ ID NO: 317468 - DNA, 592 bp, Homo sapiens
  misc_feature: GZ8MTXP01E1S88.21.61.F06.1.454.CMB.2.raw
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggcgcgacgacggcccctggacaaggtacttgaggtggatggggatggaatcagcgacttacatggttacacaaactatgacacgagaaactaccgagggcagatcacatagaccacacgacacactaccagagccaacacnccctanacgtggaacgctaggggagagcctagagactcgtacgaccgacgccgggtccgtgtaattctggttcggcggttagacggtacttcggccgacgggttccggggaccccgggtttccggacccccgggtacgggggttacccctaaccgggggttaaccccgttccgggg

SEQ ID NO: 317469 - DNA, 622 bp, Homo sapiens
  misc_feature: GZ8MTXP01E0WEK.21.61.F06.1.454.CMB.2.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctctgcaagctctgttcaccttacanctataatatcggctgggncgacacggcccctaggacaaggacttgagtggatgggatggatcgagtcgacttaacgaattacggtaacacaaactatagacaacgaacaaacgtcccgagggaacctagactcaaccaanacgacacanacacacacacganacacacgactaagagtacggacgtcgtacggggaacggacgaccgtacgtacgtacgtacgtaacgaaccggaaccggtaaccggtaccgttacgttaacgttaacgtcggttacggacggacggtaagtacgttacgttcggttacggtaaccggtcccggtcccggtacccgggtaccgggaccggtaaccggttaacccgtaacg

SEQ ID NO: 317470 - DNA, 687 bp, Homo sapiens
  misc_feature: GZ8MTXP01CAJAN.21.61.F06.1.454.CMB.2.raw
  modified_base (336)..(336): a, c, t, g, unknown or other
  misc_feature (336)..(336): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctcagtgaggtctcctgcaggtcttcgtgtttcacctttccagtctataatactcggctggtcgcgactacggcccctaggacctaggacttggacgtggagtggagtggactcgagccgtnttaacgagttcggttacaactaaactgtacggacaactaacgaaacctacccgagggtaaccaaggtaacgtcccaaccgttacgaccgaaccaaccaacgaccaccgtaacgtcccgaacgacgtaccaaaccgacgtacccgtagtacgtaggaccgtaccgttagggggaacgttcgacccgttagaaacgtaccgtcgtacggaaccggtctaccgggttccggttagtaacgttcgtcggttacggtacggagtacgggtacgttaacggcggttaccgggtccgggtccccggttaacggccccgggttacggggacccgtaaccggggttaaccccgttccggg

SEQ ID NO: 317471 - DNA, 754 bp, Homo sapiens
  misc_feature: GZ8MTXP01AY8L7.21.61.F06.1.454.CMB.2.raw
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtcgcccactcccaggttcagatgatgcagtcgtggagcgtggaggtagaaggacgccgtggggcctagaggtagtaggtcctcgtgacgtaaggtctttcgtcggtttacctacctttacagtactaatagtacgtcggngtgggcncgacgcggccctaggactaggtctggagtggagtggataggtactcgacgtcgtaacttaacgtagttacgtaaaccaacgtaaacttgacgaacgtaaacgaacggtaaaccacccgggtaaacgggaacgtaacgtaacccgtaacccaaccgtaacgtacccggaaaccaaacggacaaacctaaccgaaccaaccgaacgacgacccaaaggtacccaccgtagacgcggacgtcgaaggggacgggtactccggtaagacgcgttacccggaggaaaccccgacggttaccgggttcctttaaaggtcggttaaccgtgggggttacaacgggacgggtacgttacgttacggggccgttaacgggggttcccccggtaccccgggttccgggaaccccgggtcgggggttaaccccgtaaccggggttcccgtttccccgggg

SEQ ID NO: 317472 - DNA, 718 bp, Homo sapiens
  misc_feature: GZ8MTXP01BP3QL.21.61.F06.1.454.CMB.2.raw
  modified_base (384)..(384): a, c, t, g, unknown or other
  misc_feature (384)..(384): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctcgagtgaaggtctctgacgaaggtcttcgtggtttccacctttaccagtactaattaatacgtcggcgtgggtcgacgacgacggccccgtaggacgaaggtctggaggtgggagtgggatggatcgagcgtacttaacaagttcggtaacaaacgtaaacttacngtacaacgaaagaaacctacccggaagggctaaagacgtaccaaccgtacgtacgaaccaacacgtaacaacactaccgaacgagaaccacgacgacctacgaacggtcgaagtaccgaggggaacggacgtccctaggaagtccgtcgaacggtaccgaaccgtaaccgggttcccgtaaggtttaaccgttaacggttggaaaccggtacgggttaacggttaccgggacgtttaaacggttcgggaaaccgggttcccgggggtacccccggttaaccgggccccggggttaacggggacccggtaaccgggttaacccccggttaacggg

SEQ ID NO: 317473 - DNA, 686 bp, Homo sapiens
  misc_feature: GZ8MTXP01CRE63.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctgagtgaaggtctcctgcaaggtcttctggtttccacctttacagtactaataatagtcggctgggcacgacgacggtacccctaggaacaaggtacttggagtggagtgggatggatcgagtaccgtacttaacgaagttacggttaaacaaactaaacgttacgtacggaacaaacgtaaacgaaaaccctacccgggaaagggaacaaaggtaaaccggtacccaaaccccgataacccgaaacccaacgaacaaccaacgaactaccgaacgacgtacaaccgacgtacccaagacgtaggaacgtcgaggggaacgtacgactaggacgtactacgacgaaaccgacgtaccggtaccgttagttaactaacgttggacggtaggagtaaccggtgttacgcggttaccggtcccgggacccggttccgacccgggtcgggaccgtaaccgggttaacccgttcgg

SEQ ID NO: 317474 - DNA, 703 bp, Homo sapiens
  misc_feature: GZ8MTXP01BXHP4.21.61.F06.1.454.CMB.2.raw
  modified_base (159)..(159): a, c, t, g, unknown or other
  misc_feature (159)..(159): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (498)..(498): a, c, t, g, unknown or other
  misc_feature (498)..(498): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcattccttttcttggtggcagcagcaacaggtncccactcccaggttcagatgatgcagtctggagctgaggtgaagagccgtggggcctgagtgaaggtctccgtgactaaggtcttcgttggtttccaccctttacagtctataatgtcggngtgggcncgacgacggcccgtaggacaggtacgttgagtaggngtgggatggatcgagtcgtatacagttacgtaacaacgtaaactcgacgaacaacgtaaacggtaaacccgtaccggaacgggtcgaaacgtaacggtaccccaaccgtagtaccggaaacccaacgtacaccaaccactacccgaaagaccgaccaaacgtccgacccgtaaancgtaggacacgtaggggaacggtaccgcgtaggactacgtcgtacgaaaccgtcgtccgggtaaccttagttaacgtaacggtggaggtaaccggttagggaccgtttcggttacggccggttaccgggtcccggggttcccccggtaacggccccgggggtacggggttaccccggtaaaccgggggttccccttaacccgggg

SEQ ID NO: 317475 - DNA, 604 bp, Homo sapiens
  misc_feature: GZ8MTXP01D52RU.21.61.F06.1.454.CMB.2.raw
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttccacctttaccagtactataatagtcggctgggtgacgacgacggcccctggacaaggcttgagtggatgggatggatcagcgattaacagttacggtaacactaaactatcgacaaacgaanaaaccgtccgaaggcgaagacgtacaacgactacgaccaacacgaacaacacaccaagaacaccanactccaagatgggancgtaggggagcgcagacagtcgaggaaccgcgtacggtacgtagttacgttaacgtgacggacggaaggtacggttacgttaggccgttacgggtccgggtaccccggttcccggacccgggtacgggacccggaaccgggttaacccgtcgg

SEQ ID NO: 317476 - DNA, 650 bp, Homo sapiens
  misc_feature: GZ8MTXP01EYMEI.21.61.F06.1.454.CMB.2.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaagtctcctgcaaggcttctggtttcactttaccagtctataatatcggctgggncgacacggccctaggacaggtactgagtggagtggatggatcgagcgacttaacgattcggtaacaactaaactgtcgacaacgaacgaaaccctccgaagggcctaaggacgtaccaaccgaacgtacgaaccacgtaacgaactaaccgacacccgaacggaacgaccaacgttacgcccttaaagcgacggacgacgtaggggaacgtacgtacgagacgtccgtacgtaaccggaaccgtaaccgtaccggttacgtttaacgttacgttaacggtggttacggacgttaaggtacgtacgttacggcgttaccgggtcccggtaccccggtccgtacccgggacgggacccgtaaccgggttcccgtcg

SEQ ID NO: 317477 - DNA, 672 bp, Homo sapiens
  misc_feature: GZ8MTXP01D5HFL.21.61.F06.1.454.CMB.2.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttctggtggcagcagcaacaggtgcccactcccaggttcagatgatgcagtctgganctgaggtgagagccgtgggcctgagtgaagtctcngacaaggcttgtcgttcacctttacagtctaatatgtcggctgggcncgacgacggcccgtaggacaaggtctgaggtggagtggatggatcgagcattacagttgtaacaactaaactatacggacaacaacggtaaacctacccggaagggcctaaggtacgtacccgtaaaccgacgtacgaaaccaaacgaacacaacctaactccgaaacgcgaaccaacacgtaccgtaaccgagtacggtacgtaccgtaagggggacggtacgggtacctagggaacgtactaccggtagaaaccggaccggtaccggtacggttacgttacgttaacgtcggttacggaacggttaggtaacggtacgtttcggacgttaacgggtccggtaccccggttaacggacccccggtaggggttacccgaaccgggttcgttaacccggg

SEQ ID NO: 317478 - DNA, 676 bp, Homo sapiens
  misc_feature: GZ8MTXP01BPL2S.21.61.F06.1.454.CMB.2.raw
  modified_base (304)..(304): a, c, t, g, unknown or other
  misc_feature (304)..(304): n is a, c, g, or t
  modified_base (531)..(531): a, c, t, g, unknown or other
  misc_feature (531)..(531): n is a, c, g, or t
  modified_base (553)..(553): a, c, t, g, unknown or other
  misc_feature (553)..(553): n is a, c, g, or t
  modified_base (566)..(566): a, c, t, g, unknown or other
  misc_feature (566)..(566): n is a, c, g, or t
tcagtcgtcgctcgcacgaccggtgctcgatttagctacgctctaagggaaagggggacccaaaaaccacacccctccttggaagaatcccctagatcacagctcctcaccatggactggacctggagcattccttttcttggtggcagcagcaacaggtgcccactcccaggttcagatgatgcagtctggagctggaggtagaagaacgccgtggggcctcgagtacgaacggtctccgtgacgtaaggtcttcgttcggtttacctacctttacagtactaataatggtccgtagtgggtnacgacgtacggcccctaggaccaagggtacttaggaggtaggtaggtagggggtagtacgggtaacttccggaggtcggttaacctttaacgtaaacggttacggtttaaccaaacttaaaactcgtacacgactaaaacggaaccctacccgggagggaacaggacctacaccgtataccgacactacactagacgaccaggactacacgccgactacgcgtagancggtaggacgacgctaggtacncgtagcgaaaccncgtcccgtagttcgtagtcttaggcgacggttagagggttccaggcgttacgggtccgtacccgggtccgtaccccgggcgggttaccgtccgggttaaccgttcccggg

SEQ ID NO: 317479 - DNA, 707 bp, Homo sapiens
  misc_feature: GZ8MTXP01DN9YF.21.61.F06.1.454.CMB.2.raw
  modified_base (160)..(160): a, c, t, g, unknown or other
  misc_feature (160)..(160): n is a, c, g, or t
  modified_base (193)..(193): a, c, t, g, unknown or other
  misc_feature (193)..(193): n is a, c, g, or t
  modified_base (511)..(511): a, c, t, g, unknown or other
  misc_feature (511)..(511): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtncccactcccaggttcagatgatgcagtctgganctgaggtagaagagccgtgggcctgagtgaaggtctcgtagactaggtctttcgtcggtttaccacctttaccagtactaattatagtcggcgtgggacgacgtacgcggtacccctagggaccaagggtacttaggaaggtcgggtagttaggggacgtaggacgtcgacgtaccgtactttaacgtaagttacgggttaaaccaactaaaacgttacgacgaacaacgtaacgaaacctacccggaagggcagacgtacaacatacgaaccaacacgaccacgacacgaacgacgaccacttaacgactacgaagnggacgagacgggacgacgtacgtagaacgtcgtcggacgtaaccgtaccgtacggttaccgttagttaacgttaacggtcggacggtaacggttacggtacgttacggttacggttccgggttacgggtccccggggttaccgtcccggggacccgggtccggggttacccggtaacccgggttaacccgttccgg

SEQ ID NO: 317480 - DNA, 528 bp, Homo sapiens
  misc_feature: GZ8MTXP02G5P45.21.61.F06.1.454.CMB.2.raw
  modified_base (434)..(434): a, c, t, g, unknown or other
  misc_feature (434)..(434): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtgcgacaggcccctggacaaggacttgagtggatgggatggatcagcgcttacaatggttacacaaactatgcacagaaactccagggcagagtcaccatgaccacagacacatccacgagcacagacctacagtggagctaggaggagcctgagatcgngacgacacggccgtgtacttacgtgtgacgtagacggtcgttagcgaggtcggcccggttacggaccccgtggggaccacggggaaccctcggg

SEQ ID NO: 317481 - DNA, 521 bp, Homo sapiens
  misc_feature: GZ8MTXP02IA58F.21.61.F06.1.454.CMB.2.raw
  modified_base (276)..(276): a, c, t, g, unknown or other
  misc_feature (276)..(276): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtncgacaggcccctggacaaggacttgagtggatggatggatcagcgcttacaatggttaacacaaactntgacacagaaactccagggcagatcaccatcgaccacagacacanccacgagcacagcctacatggagctggaggagcctgagatcgtagacgacgacggccgtagtacttacgtgtgcgtagacggtcttagcaggtcggcccggttcgacccgtggggcccacgggaaccctcgg

SEQ ID NO: 317482 - DNA, 586 bp, Homo sapiens
  misc_feature: GZ8MTXP02F889F.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatgggatggatcagcgcttacaatggttacacaaactatgacacagaaactccgagggcagacgtcaccatcgaccacagacacactaccacgagacacacgaccctacagtggagcgtaggaggacgccgtaggagaactcgtaggaaccgacgaccgggccgtagtacttacgtaggtcggacggaggacggtccgttaagcgtaacgggtcggtccccggggtttaccggacccccggttgggggacccgtaaccgggggtaccccgttaccggg

SEQ ID NO: 317483 - DNA, 542 bp, Homo sapiens
  misc_feature: GZ8MTXP02JBBLA.21.61.F06.1.454.CMB.2.raw
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatggatggatcgagcgcttacatggtacacaaactatgcacagaactccagggcagagtcacatcgaccanagacacacnccacgagcacagcctanagtgagctggaggagcctagagatcgtagacgacgacggtccgtagtacgttactggtgacggagacggtccgttagcgtaggtcgggtccccggttacggacccccggtgggggacccacggggtaacccctcggg

SEQ ID NO: 317484 - DNA, 692 bp, Homo sapiens
  misc_feature: GZ8MTXP02JBIG4.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacacggcccctggacaaggacttgagtggatgggatggatcgagcgcttacaatggttaacactaaactatgacacaagaaactccgagggcagacgtcaaccatacgaccacaacgacacactaccaacgaagaccacaacgaccctaacgacgtgggaacgccgtaggaagggaacgcccgttagggaaacgtacgttacccgtaaggaaacccggtaaccgaaccgggggtcccggttaagtttaacgtttaaaccggtcgggttaggaaccgggtaaagggtaacgggtaccgtttaaaacggcccggttaacggggttcccgggggtacccccggggtttacccgggaaccccccggggttggggggaccccccggtaaacgggggttaaacccccgtttccgggg

SEQ ID NO: 317485 - DNA, 514 bp, Homo sapiens
  misc_feature: GZ8MTXP02HF0W8.21.61.F06.1.454.CMB.2.raw
  modified_base (278)..(278): a, c, t, g, unknown or other
  misc_feature (278)..(278): n is a, c, g, or t
  modified_base (382)..(382): a, c, t, g, unknown or other
  misc_feature (382)..(382): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcgagcgcttacaatggttacacaaactatgacacagaaactccagggcagatcacatgaccanagacacatacacgagcacagcctacatggagctagaggagcctgagatcagacgacgacggccgtgtacttacngtagcgagnggacttagcgaggtcggccgttcgaccccgtgggccacgggaccctcgg

SEQ ID NO: 317486 - DNA, 552 bp, Homo sapiens
  misc_feature: GZ8MTXP02JS77F.21.61.F06.1.454.CMB.2.raw
  modified_base (388)..(388): a, c, t, g, unknown or other
  misc_feature (388)..(388): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatgggatggatcgagcgcttacaatggttaacacaaactatgacacagaaactccgaagggcagagtcaccatcgaccanagacacatccagagacacagaccctaacatggaacgcgtaggaggagccctaggaagaactcgtacgaacgacaccgggtccgtagtacttacgtgtgcggtagacggtcttagctaggtcggcccggttcggacccccgtgggggacccacgggacccgtcgg

SEQ ID NO: 317487 - DNA, 628 bp, Homo sapiens
  misc_feature: GZ8MTXP02JAOIE.21.61.F06.1.454.CMB.2.raw
  modified_base (439)..(439): a, c, t, g, unknown or other
  misc_feature (439)..(439): n is a, c, g, or t
  modified_base (517)..(517): a, c, t, g, unknown or other
  misc_feature (517)..(517): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacacggcccctggacaaggacttgagtggatggggatggatcgagcgtcttaacaagtggttacaactaaactatgacaacaagaaactccgaaggggcagacgtacaacccatacgaaccacagaacacactaccaacgagaccaacacgaccctaanacgtgggaacacgtaggaagggacgaccgtaggaagaacgtcgaggacgaccgaaccggtaccgtagtaactttacgnggttacggacgtaaggacgggtccttaaggactaacgggttccgggacccccggtttaccggaacccccggttcgggggacccgtaaaccgggggtaacccgttcccgggg

SEQ ID NO: 317488 - DNA, 520 bp, Homo sapiens
  misc_feature: GZ8MTXP02IS6UH.21.61.F06.1.454.CMB.2.raw
  modified_base (275)..(275): a, c, t, g, unknown or other
  misc_feature (275)..(275): n is a, c, g, or t
  modified_base (409)..(409): a, c, t, g, unknown or other
  misc_feature (409)..(409): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatcctttcttggtggcagcagcaacaggtgcccactcccaggttcagatgatgcagtctggagctgaggtgaagaagcctggggcctcagtgaaggtctcctgcaaggcttctggttcaccttaccagctataatatcggctgggtncgacaggcccctggacaaggactttggagtggatggggatggatcagcgcttacaatggttacacaaactatgcacagaaactccagggcagagtcaccatgaccacagacacatccacgagacacagccctanactggagctgaggagcctgagatcgtgacgacacggccgtagtacttacgtgtgcgagaggcttagcagtggcccggttcgaccccgtggggacccaggggaacccttcgg

SEQ ID NO: 317489 - DNA, 547 bp, Homo sapiens
  misc_feature: GZ8MTXP02F8C8A.21.61.F06.1.454.CMB.2.raw
  modified_base (278)..(278): a, c, t, g, unknown or other
  misc_feature (278)..(278): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaggacttgagtggatggatggatcagcgcttacaatggtacactaaactatgcaacagaactcagggcagagtcacatagaccanacacacataccagacgacacacgacctacatcgganctagagganccgtagagatcgacgacgacgacggcgtagtacttacgtgtcgacgtagacggtcttaagcgtaaggtcggtaccccggttacggacccccggtagggggcccgtaacggggtacccttcggg

SEQ ID NO: 317490 - DNA, 579 bp, Homo sapiens
  misc_feature: GZ8MTXP02HS5KS.21.61.F06.1.454.CMB.2.raw
  modified_base (279)..(279): a, c, t, g, unknown or other
  misc_feature (279)..(279): n is a, c, g, or t
  modified_base (438)..(438): a, c, t, g, unknown or other
  misc_feature (438)..(438): n is a, c, g, or t
  modified_base (503)..(503): a, c, t, g, unknown or other
  misc_feature (503)..(503): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaaggacttgagtggatggatggatcagcgcttacaagtggttaacacaaactatagacacaagaaactccgaaggggcaaggactcgaaccctagtacgaaccaacacgaacaacataccaacgacgacactacgaccctaanatggagctaggaaggagacctaggaacgatccgagaacgacgacggtaccgtagtaactttacgngtacggacgtaggacgtcgtacgcgtaggtccggtccggtaccggacccggtcgggacccgacgggtacccgtcgg

SEQ ID NO: 317491 - DNA, 576 bp, Homo sapiens
  misc_feature: GZ8MTXP02H9CEA.21.61.F06.1.454.CMB.2.raw
  modified_base (278)..(278): a, c, t, g, unknown or other
  misc_feature (278)..(278): n is a, c, g, or t
  modified_base (337)..(337): a, c, t, g, unknown or other
  misc_feature (337)..(337): n is a, c, g, or t
  modified_base (440)..(440): a, c, t, g, unknown or other
  misc_feature (440)..(440): n is a, c, g, or t
  modified_base (492)..(492): a, c, t, g, unknown or other
  misc_feature (492)..(492): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttctacctttaccagctataatatcggctgggtncgacacggcccctggacaaggacttggagtggagtggggatggatcgagcgtacttaanaatggttaacaacaaatacagaccacaagaaactccgagggcagacgtaccaccatcgaaccacacgacacatccaacgacgcacacgaccctacagtaggancgtaggacggagcctaggagatcgagaccgacgacggccgtagtacttacgngtaggacgaggacgtcgtacgcgtacggtccgggtccccggttaccggaccccggtggggacccgtacggggtaaccccgtcgg

SEQ ID NO: 317492 - DNA, 672 bp, Homo sapiens
  misc_feature: GZ8MTXP02JAFVR.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctaggacaaggacttggagtggatgggatggatcgagcgacttaacaagtggttaacaaacgaaacttatagaccaacgaagaaacctccgaaggggccaaggacgtaccaaccagtacgaacccacaagaccacactccaacgacgaccaacgacgaccctacgacgtcggaacgccgtaggaacgggacgacccgtagggaacgtacgtaccgtacggaaccgaacgacccggggtaccgttagttaaacgtttaaccgtggtacggaccggaaaggtacggtaccgttaacggccgtaacggggttcccggggtccccgggtttacccggaaccccccggttgggggaccccgtaaccgggggtaacccccgtttcgggg

SEQ ID NO: 317493 - DNA, 535 bp, Homo sapiens
  misc_feature: GZ8MTXP02JGSOY.21.61.F06.1.454.CMB.2.raw
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaggacttgagtggatgggatggatcagcgcttanaatgtacacaaatntgcacagaaactcagggcagagtcaccatcgaccanaagacacactaccacgagacacacgccctaacatggaagccgtaggacgggagccgtaggacgtagtcctaggacgacgacggccgtagtacttacgtggtagcgagacggtcttagcaggtcgccggttcgacccgtggggaccacgggacctcgg

SEQ ID NO: 317494 - DNA, 643 bp, Homo sapiens
  misc_feature: GZ8MTXP02I09KW.21.61.F06.1.454.CMB.2.raw
  modified_base (217)..(217): a, c, t, g, unknown or other
  misc_feature (217)..(217): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggttcaccttacagctaataatatcggctgggtgcgacacggcccctggacaaggacttgagtggagtggatggatcgagcgtcttaacaagttggttaacaacgtaaaactatacgacaacaagaaactccgagggcagacgtccaaccatacgaccacaagacacactaccgaacgacgacaccgtacgaccctaacagtggacgaccgtaggaacgggacgcccgtaggaacgtacgtcgtacggaaccgaaccgaccgggtacccgtagttaacgtttaaccgtggttacggaccgggtaaggacgggtaccgtttaaagggccgtaagggtccggggtccccgggtttaccggacccccgggtgggggaccccgaacggggtaaccccggttcggg

SEQ ID NO: 317495 - DNA, 632 bp, Homo sapiens
  misc_feature: GZ8MTXP02H0IXE.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctaataatatcggctgggtncgacaggcccctggacaaggacttgagtggatgggatggatcgagcgcttacaatggttaacaacaaactatagacacaagaaactccgagggcagagtaccacatcgaccacacgacacactccacgagacaacacgaccctaacgacgtagggaacgtaccgtagggaacgggagacccgtaggaacgtacgtacggtacggaaaccggaccggaccgggtcccgttagttaacgtttaaccgtggttacggacggtaaggacggttacgtacgtacgacgggttccgggccccgggtttaccggacccccggtacgggggaccccgtaacggggtaaccccgttccgggg

SEQ ID NO: 317496 - DNA, 538 bp, Homo sapiens
  misc_feature: GZ8MTXP02HELR4.21.61.F06.1.454.CMB.2.raw
  modified_base (470)..(470): a, c, t, g, unknown or other
  misc_feature (470)..(470): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatggatggatcagcgcttacaatggttacacaaactatgacacagaactccgagggcagagtcacatcgaccacagacacatccagagcacagcctaacagtggagctaggacggacgccgtaggagacttcgaggaccgacgaccggccgtagtacttacnggtagcgagacggtcttacgcgaggtcggtcccgttcggaccccgtggggacccacggggaccctcgg

SEQ ID NO: 317497 - DNA, 631 bp, Homo sapiens
  misc_feature: GZ8MTXP02JVX1C.21.61.F06.1.454.CMB.2.raw
  modified_base (402)..(402): a, c, t, g, unknown or other
  misc_feature (402)..(402): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctaataatatcggctgggtgcgacacggcccctggacaaggacttggagtggagtgggatggatcgagcgtacttaacaagttggttaacactaaaactatgacaacaagaaacctccgagggcagagtccaccatcgaaccanacgaacacactccaacgagaccaacacgaccctaacagtacgggacgcgtaggacgggacgtcccgtaggaacgaacgtccgtacggaaaccgacgaccgggtacccgttagttaactttacgtggtggacggaggtaacggtcgttaaggccgtaacggttccggggtccccggtttacccggaccccgggttcgggggacccgtaaccgggggtaaccccttcgggg

SEQ ID NO: 317498 - DNA, 662 bp, Homo sapiens
  misc_feature: GZ8MTXP02JGD6J.21.61.F06.1.454.CMB.2.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggganctgaggtgaagaagcctggggcctnagtgaaggtctcctgcaaggcttctggttcacctttaccagctataatatcggctgggtncgacacggcccctggacaaggacttgagtggatggatggatcgagccgtacttaacgaagttggttaaacaactaaaactgtagaccaaacaacgtaaacctaccgaggggccaagggtaacgtcccaaaccaagtaccgaacccaacgaacgaccaaaccactacccgaaacgaacgaccaacgacgtaccctaaacgagtacggacgacgtagggaacggacgtaccgtaggaacgtacgtacgaacggaccggtaaccggtaccggtacgttagttacgttacgtggacggacggaaggtacggtacgtacggacgtacgggtcccggtaccccggttaccgggacccggtacggggacccgtaaccgggtacccgtacgg

SEQ ID NO: 317499 - DNA, 532 bp, Homo sapiens
  misc_feature: GZ8MTXP02JYNLM.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaggacttgagtggatgggatggatcagcgcttacaatggttacacaaactatgcacagaaactccgagggcagagtcaccatcgaccacagacacatccacgagcacagcctacatggagctgaggagcctagagatcgtagacgacgacggtccgtagtacttacgtgtgcggagacggtctacgcgaggtcggtcccggttcgaccccggtcggggcccgacggggacccgtcggg

SEQ ID NO: 317500 - DNA, 502 bp, Homo sapiens
  misc_feature: GZ8MTXP02FTCOA.21.61.F06.1.454.CMB.2.raw
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (394)..(394): a, c, t, g, unknown or other
  misc_feature (394)..(394): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcagcgcttacaatggtacacaaactatgcanagaaactccagggcagagtcaccatgaccacagacacatccagancacagcctacatgagctgagagcctgagatctgacgacacggaccgtgtattactgtgcgagagcgtagcgagtggccggtcgacccgtcggccgacggaccgtacgg

SEQ ID NO: 317501 - DNA, 633 bp, Homo sapiens
  misc_feature: GZ8MTXP02J2WC7.21.61.F06.1.454.CMB.2.raw
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaaggcttggagtggatggggatggatcgagcgcttaacaattggttaacactaaaactntgcaacaagaaactccgagggcagacgtcacatcgaaccacagacacactaccacgagcacaacgcctaacgagtacgggagtaccgtgggaaggacgacccgtagggaacggtactccggttaacggaaccggaccgaaccggggtcccgttagttaacgttaccgtggtacggaccggaagtacgggcgttaacggccgtaacggggttccggtacccccgggttaccggacccccggttagggggaccccgtaaaccgggggaccccgtttcgggg

SEQ ID NO: 317502 - DNA, 581 bp, Homo sapiens
  misc_feature: GZ8MTXP02IRYFK.21.61.F06.1.454.CMB.2.raw
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaggcttgagtggatggatggntcagcgnttacagttgtaacacaaactntgcaacaagaaactccgaagggcagacgtcaccatcgaccaacagacactanccaagacgccacacgccctaanagnggancaggagacgcgtagagtactcgagacgacgacggtcgtagtacttacgtgtacggacggtaaggtacggtacgttacggacggttacgggttcccggggtcccccgggttaccggaccccggggtacggggtacccggaaccggggtacccgtcgg

SEQ ID NO: 317503 - DNA, 571 bp, Homo sapiens
  misc_feature: GZ8MTXP02IY661.21.61.F06.1.454.CMB.2.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggtttcacctttaccagtctataatatcggctgggtncgacacggcccctggacaaggacttgagtggatgggatggatcgagcgcttacaaattggttaacaacaaactatgacaacaagaaactccgaagggcagagtccaaccatcgaaccacaacgacacactaccacgagacacacgacctacagtggagcgtaggacggagacctaggacgactcgtaggaacgacgaccggccgtagtacttacgtggtagcggagacggtcttaggcctagggtccggtcccggttaccgaccccgtagggccgaccggtaacggtacccg

SEQ ID NO: 317504 - DNA, 559 bp, Homo sapiens
  misc_feature: GZ8MTXP02FOJUO.21.61.F06.1.454.CMB.2.raw
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
  modified_base (487)..(487): a, c, t, g, unknown or other
  misc_feature (487)..(487): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagtctataatatcggctgggtgcgacaggcccctggacaaggacttgagtggatgggatggatcgagcgcttaacaaattggttaacaacaaaactatacgacaacaagaaacctccgaaggggcaagagtcaccatcgaccanagacacanccagagcacagccctanagtggagcgtagaggacnccgtagagacttcgagacgacgaccggtccgtagtattacgngtgcgagacgtcgtacgctaaggtccggtcccggttcggacccccgtggggacccacggggaacccttcggg

SEQ ID NO: 317505 - DNA, 548 bp, Homo sapiens
  misc_feature: GZ8MTXP02HSK3J.21.61.F06.1.454.CMB.2.raw
  modified_base (278)..(278): a, c, t, g, unknown or other
  misc_feature (278)..(278): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggactttgagtggatggatggatcgagcgcttacaatgttacacaaactatgcacagaaactccgagggcagatcacancgaccacagacactanaccagacgcacacgctacagtgagctaggaggagccgtagacgatacgcgaacgacgaccggccgtagttacttacgtgtgcgaaggcggacgttagaccgaggttcggccccggttcggacccccggtgggggacccacggggtaaccccgtcggg

SEQ ID NO: 317506 - DNA, 630 bp, Homo sapiens
  misc_feature: GZ8MTXP02JRUUY.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcgagcgtcttacaagttggttaaccaacaaactatgacacaagaaactccgaagggccaggagtaccaccatacgaccacagacacactaccacgacgacaccacgtaccctaacgagtgggaacgccgtagggacgggacgaccgtaggaacgtaacttaccgttaaacggaccgtaaccgggtcccgttaagttaacttacgttggtacggacggaaggtaacggtccgttaacggcgtacggtccgggtccccggttaccggacccccggtgggggaccccgaacggggtaaccccgttggtaccccg

SEQ ID NO: 317507 - DNA, 590 bp, Homo sapiens
  misc_feature: GZ8MTXP02HHVIG.21.61.F06.1.454.CMB.2.raw
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (425)..(425): a, c, t, g, unknown or other
  misc_feature (425)..(425): n is a, c, g, or t
  modified_base (494)..(494): a, c, t, g, unknown or other
  misc_feature (494)..(494): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggttcacctttaccagctataatatcggctgggtgcgacacggcccctaggacaaggactttggagtggatgggaatggatcgagcgtacttaanaagtggttaacaacaaactatgacaacagaaactcgagggcaggatcacancgaccacagacacacaccacgagcaacagaccctanactggacgctaggacggacgcctaggaagactcgacggaacgacgacggtaccgtagtaactttacggnggtacgacggtaagtacggtacgttacggacggtacggtccgggtacccggtaccggtaccccgggtacggggacccgtaaccgggtacccgtcgg

SEQ ID NO: 317508 - DNA, 597 bp, Homo sapiens
  misc_feature: GZ8MTXP02IUE3B.21.61.F06.1.454.CMB.2.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgcaaggcttctggtttcacctttaccagctataatatcggctgggtncgacaggcccctggacaggacttgagtggatgggatggatcgagcgcttaacagttggttaacaactaaactatgacaacagaaactccgagggcagacgtcaccatacgaccacagacacactaccacgagacacagccctaanagtgganacgtaggacggtacgccgtaggaacgacgtcgtacggaaccgaccgtaccgggtcccgttaggttaactttaacgtggtcggacggaggacggtcgttaacggcgtagggtccgggtccccggttacggaacccccggtggggacccgaacggggacccgttccgg

SEQ ID NO: 317509 - DNA, 728 bp, Homo sapiens
  misc_feature: GZ8MTXP02GYBPR.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccaacacccctccttggaagaatccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcaaggcttctggtttcacctttaccagctatatatcggctgggtncgacacggcccctggacaaggacttgagtggagtgggatggatcgaggcgtactttaacgaagttcggttaacaaacgtaaaacttacgtacgaaccaaccgaaacgtaaaacctcccggaaaggggccaaacggtacggttaacccaaacccgtaagtaaccggaaacccaaacgaacgaaacccaaaccaacgtaccccaaacggaacgacccaaactaaccggaccctaaaccgagtacgggaacgccgtagggaacggacgcccgttagaacggtacttccgaggaaccgaaccgaccgggtaccggttagttaactttaccggtaggttacgggacgtaacgggtagggtacccgtttaaggcgtaacgggttccggggtaccccccggtttacgggaccccccggttgggggaccccgtaaccgggggtaaccccgtttccgggg

SEQ ID NO: 317510 - DNA, 613 bp, Homo sapiens
  misc_feature: GZ8MTXP02JTES1.21.61.F06.1.454.CMB.2.raw
  modified_base (278)..(278): a, c, t, g, unknown or other
  misc_feature (278)..(278): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcgagcgacttacaatggttaacactaaaactatgacacagaaactccgagggcagacgtcaccatcgaccanagacanactaccacgagacacagacctacagtggaacgcgtaggacggagccctaggaacgacttacgagacgacgaaccggccgtagtaactttaaccgtggtacggtccggaaggtagggacctttaaggaccgtaacggggtccggggtcccccgggtttaccgggaaccccccggttcgggggacccccggaacgggggtaaaccccctttccggggg

SEQ ID NO: 317511 - DNA, 673 bp, Homo sapiens
  misc_feature: GZ8MTXP02G3I0M.21.61.F06.1.454.CMB.2.raw
  modified_base (279)..(279): a, c, t, g, unknown or other
  misc_feature (279)..(279): n is a, c, g, or t
  modified_base (430)..(430): a, c, t, g, unknown or other
  misc_feature (430)..(430): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagctataatatcggctgggtncgacacggcccctggacaaggacttggagtggatgggatggatcgagcgacttacaagtcggttaacaacgtaaactagtgacaacgaacgaaacctccgaagggccaagtaacgtccaaccatacgaaacccaacgaacgaacaaccaancccgaacgagaccacacgaccctaagagtagggacgccgtaggaacggacgacccgtagggaacgtaaccgttaccgacggaaacccggtaaccggacccggggtacccgttagttaacgtttaccggtggtacggaccggtaaaggtacggtaccgttaaggcgtaacgggttccgggtacccccgggtttacccggaccccgggttacgggggaccccgaacgggggtaaccccttccggg

SEQ ID NO: 317512 - DNA, 641 bp, Homo sapiens
  misc_feature: GZ8MTXP02JG4R7.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttcgtggtttcacctttaccagtctataatatcggctgggtgcgacaggcccctggacaaggcttgagtggatgggatggatcagcgtcttacaagtggttaacaactaaactactgacacaagaaactccgaagggccagataccaccatcgaaccacacgacaacactaccacgagacaacacgacctaacgagtaggacgacgtaggaacgggacgacccgtagggaacgtacgttaccgtacggaaccgaacgtaccggggtaccgttagttaacgtttaaccgttggtacggaaccggtaggtaacgggtcgttaaacggcgtaacgggttccgggtccccgggtttacccggaacccccgggttcgggggacccgtaacggggaaccccgttccggg

SEQ ID NO: 317513 - DNA, 538 bp, Homo sapiens
  misc_feature: GZ8MTXP02JCUMJ.21.61.F06.1.454.CMB.2.raw
  modified_base (349)..(349): a, c, t, g, unknown or other
  misc_feature (349)..(349): n is a, c, g, or t
  modified_base (469)..(469): a, c, t, g, unknown or other
  misc_feature (469)..(469): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggccccctggacaaggacttggagtggatggggatggatcgagcgcttacatggttacacaaactntgcacagaaactccgagggcagagtcaccatcgaccacagacacactaccacgagcacagcctacagtggagctaggaggacgcctggacgatcgtagacgacgacggccgtgtattacngtgcgtagacggcttacgcgtaggtcggcccggttacgaccccgtggggacccgacgggtaaccctcgg

SEQ ID NO: 317514 - DNA, 663 bp, Homo sapiens
  misc_feature: GZ8MTXP02HUY5E.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagtctataatatcggctgggtncgacacggcccctggacaaggacttgagtggatggatggatcgagcgcttaacaagtggttaacaactaaaactagtagacaaacgaagaaaactccgaaggggccaagacgtcaaccatacgaaacccacaagaaccaacactacccaacgacgaccaacaacgaccctaaacagttacgggaacgtccgtaggaagggacgaccctagggaagtacgttacgtacggaaaccggaaccgaaccggggtcccgttaaggttaactttaccggtaggttacggaccggaaggacgggtactttaacggccgtaaggggtcccgggtaccccgggtttaccggacccccggtcgggggacccctaacgggggtaaccccttcgggg

SEQ ID NO: 317515 - DNA, 555 bp, Homo sapiens
  misc_feature: GZ8MTXP02FU7JG.21.61.F06.1.454.CMB.2.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaaggactgagtggatgggatggatcagcgcttacaatggtacactaaactatgcanagaaactcgagggcagacgtcaccatacgaccacagacacataccacgagacacacgcctacacgtggagctaggaggagcccgtagaagacgtctagacgaacgacggccgtgtaacttacgtgtggcgaggacggtacttacgcgtaggtcggtccccggttaccgaccccgtcgggggacccgaacggggtaccctacggg

SEQ ID NO: 317516 - DNA, 692 bp, Homo sapiens
  misc_feature: GZ8MTXP02HTSD1.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacacggcccctggacaaggacttgagtggagtggatggatcgagtcgtacttaacgaagttacggttaacaactaaactatcgacctaacaacgtaaactccgagggccaagactaccgaaccagtacgaaccaacgaacgaaccaaccacacccaacgacgacaaccacgaccctaagacgtagggacgtccgtaggaacgggtaacgtcccgtaggtaacgaacgttcgtacggaacccggaaccgtacccggggtaccgttagttaacgtttaacgtcggttacggaccgggtaaaggtacgggtacgtttaacgggccgtaaacggggttccgggtaacccccggggttcccggtaacccccgggtgggggtaacccccgaaccgggggttaacccccggttccggg

SEQ ID NO: 317517 - DNA, 642 bp, Homo sapiens
  misc_feature: GZ8MTXP02I0HPU.21.61.F06.1.454.CMB.2.raw
  modified_base (193)..(193): a, c, t, g, unknown or other
  misc_feature (193)..(193): n is a, c, g, or t
  modified_base (448)..(448): a, c, t, g, unknown or other
  misc_feature (448)..(448): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggganctgaggtgaagaagccgtgggcctcagtgaaggtctcctgcaaggcttcgtggttcacctttaccagctataatatcggctgggtgcgacgacggcccctaggacaaggacttggagtggagtgggatggatcagcgcttaacaagtacggttaacaactaaaactatacgacaacaacgaaactcgaagggcagacgtacaccatacgaaccacagacacactaccacgagacacgacgacctacagtacggancgtaggaaggaccgcgtaggagtaactcgtaacggaccgacgaccggtaccgtagttaacgtacgttcggtaggaccggaaaggtacggtaccgttaaacggccgtaacgggtccgggtacccccggggttaccggtaaccccccggggttacgggggtaaccccggaaccgggggtaacccctttcccggggg

SEQ ID NO: 317518 - DNA, 637 bp, Homo sapiens
  misc_feature: GZ8MTXP02G1T1R.21.61.F06.1.454.CMB.2.raw
  modified_base (503)..(503): a, c, t, g, unknown or other
  misc_feature (503)..(503): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcacctttaccagtctataatatcggctgggtgcgacacggcccctggacaaggacttggagtggagtgggatggatcgagcgtacttaacgaagttacggttaaccaaactaaaactactacgaccaaacgaaacgtaaacctccgaaggggccaaggtacgtaccaaccagtacgaacccaacaacgaacaaccactacccgaaacgacgaccaaccacgaccctaaacagtggaacgcgtagggaacggacnccgtagaacgtactcgacgaccgaacgacggtccgtagtaacttacgtggtagacgtaggacggtactagacgtacggtcggtccccggttaccggaccccgttgggggaccctaaccggggtacccgtccggg

SEQ ID NO: 317519 - DNA, 636 bp, Homo sapiens
  misc_feature: GZ8MTXP02H489L.21.61.F06.1.454.CMB.2.raw
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
tcagtcgtcgctcgcacgaccggtgctcgatttagctacgctctaagggaaaggggacccaaaaaccacacccctccttggaagaatccccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtgcgacgacggcccctggacaaggacttggagtggatggggatggatcagcgtacttaacaagtggttaacacgaaaactactagacacagaaacctccgagggcaagtancaccanacgaccacagacacacnccaacgagacaacacgaccctaanagtacggatacgtggaacggagcccgtaggaacgtacgtcgacggaaccgaccgtaaccgggccgtttagtaactttaaccggtggttcggaacgagggacggtaacgttcggacgtacggggttcccgggcccccggggtttaccggaccccccgggttgggggtacccccggaaacgggggtttaacccccgtccggggg

SEQ ID NO: 317520 - DNA, 574 bp, Homo sapiens
  misc_feature: GZ8MTXP02HBAXE.21.61.F06.1.454.CMB.2.raw
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcaccttttaccagtctataatatcgtctgggtgcgacacggcccctggacaaggactttgagtggatgggatggatcgagcgtcttaacaagttacggttaacaactaaaactagtgacaacaagaaaactccgaagggcaagacgtcaccatgaaccacagacacanccaacgagacaccacgccaacatggacnctaggacggagcctagggaanatcgagaccgacgacggtccgtagtactacgtgtacgcgagtacgtacgtacgacgacggtccggtcccggtacccggacccggtacgggacccgaccgggtaccctcgg

SEQ ID NO: 317521 - DNA, 631 bp, Homo sapiens
  misc_feature: GZ8MTXP02G6PG1.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatggatggatcagcgtacttacaattggttaacaacgtaactactagacaacaacgaaactccgaagggccaggacgtacaccatacgaccaacacgaacacactaccacgagacacacgacctacagtggaacgcgtaggaggaacgccgtaggaacgacgtccgtagaaccggaacgaccgggtaccgttagttacgtttaacgtggtacggacggtaaggtacggtacgttaacggccggtaaagggtcccggggtaccccgggttaccgggtaacccccggtcgggggacccggtaaaccggggtacccgttaccgggg

SEQ ID NO: 317522 - DNA, 539 bp, Homo sapiens
  misc_feature: GZ8MTXP02HH4PV.21.61.F06.1.454.CMB.2.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaggacttgagtggatgggatggatcagcgcttaacaatggttaacaacaaactatgacactagaaaactccgaagggctaagacgtacaccatcgaaccacagacaacacnccaganacacacgcctacgatgggacncgtaggacggagcctagagactcgtagacgacgtacggcgtagtatttacgngtgcgagacgtctacgcgtagtccggtccgtacgccggtggccgacggaccgtcg

SEQ ID NO: 317523 - DNA, 607 bp, Homo sapiens
  misc_feature: GZ8MTXP02F5X96.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaaggacttgagtggatgggatggatcagcgcttacaatggttaacaacaaactatagacaacaagaaaactccgaagggcaagacgtaccaaccagtacgaccaacaacgacaacactaccaacgagaccacgaacgaccctaacagtggagccgaggaaggacgccgtagagaacttcgagaccgacgacgggccgtagtaacttacgtggtcgacggaggacggtaccgttagcgtaaggtccgggtccccgggtttacccggacccccggtcgggggaccccgtaacgggggtaaccccgttaccgggg

SEQ ID NO: 317524 - DNA, 536 bp, Homo sapiens
  misc_feature: GZ8MTXP02FLG78.21.61.F06.1.454.CMB.2.raw
  modified_base (416)..(416): a, c, t, g, unknown or other
  misc_feature (416)..(416): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatgggatggatcagcgacttacaatggtacacaactatgacacagaactccgagggcagactcaccatgaccacagacacatccacgagacacacgacctacatggancgtaggacggagccgtaggagactcgtagaccgacaccgggcgtagtattacgtgtcgcgagacggacttagctaggtcggcccggttaccgacccggtggggaccacggggaccctcgg

SEQ ID NO: 317525 - DNA, 574 bp, Homo sapiens
  misc_feature: GZ8MTXP02H50R5.21.61.F06.1.454.CMB.2.raw
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (395)..(395): a, c, t, g, unknown or other
  misc_feature (395)..(395): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacaggcccctggacaaggacttgagtggatgggatggatcgagcgacttacaattggtacacaaactntgacacagaaactccgagggcagagtcaccatgaccacagacacanccaacgagacacacgacctaacatggaagtccgtaggaacgggacgtcctaggacgatcgtaggaccgaacgacggtaccgtaggtactttacgtggtggacggtagaacggtcgttaacggcgtaggtccggtcccggttaccgaccccggtggggacccgtaacgggacccgtcggg

SEQ ID NO: 317526 - DNA, 618 bp, Homo sapiens
  misc_feature: GZ8MTXP02HX5T3.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggcctcagtgaaggtctcctgcaaggcttctggtttcacctttaccagctataatatcggctgggtncgacaggcccctggacaaggacttgagtggatgggatggatcgagcgcttaacatggttaacaactaaactatgacacaagaaactccgaaggcagacgtccaccatcgaccacaagacacaactaccaacgaacgacaacacgaccctaaacagtaggaacgtcgtaggaacgggtacgacccgtaggacgtaacgtcgtaggaaccgaacgaccggtaccgtagtaacttacgtggttcggacgtaggacggtccgttaagccgtaacgggtccggtaccccgggttacccggtacccccggtcgggggacccgtaaccgggggtaaaccccgtcgggg

SEQ ID NO: 317527 - DNA, 652 bp, Homo sapiens
  misc_feature: GZ8MTXP02G4PYY.21.61.F06.1.454.CMB.2.raw
  modified_base (192)..(192): a, c, t, g, unknown or other
  misc_feature (192)..(192): n is a, c, g, or t
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggttgcagcagcaacaggtgcccactcccaggttcagatgatgcagtctgganctgaggtgaagaagcctggggcctcagtgaaggtctcctgcaaggcttctggtttcacctttaccagctataatatcggctgggtncgacaggcccctggacaaggacttgagtggatgggatggatcgagcgtacttaacaagtggttaacaacgtaaaactatagacaacaagaaaactccgaagggccaagacgtacaaccatacgaaccaacaacgacaacactacccaagacgaccaactacgaccctaacagtaggaacgcgtaggaacgggagaccgtaggaacgtacgttacgacggaaaccgaaccgaccgggtacccggttagttaacgtttaccggtggtacggacggaacgggtacggtaccgttacggaccgtaacgggttcccgggtacccccgggttacccggaccccgggtacgggggacccgtaaccggggtaacccgtccgg

SEQ ID NO: 317528 - DNA, 558 bp, Homo sapiens
  misc_feature: GZ8MTXP02ILDNV.21.61.F06.1.454.CMB.2.raw
  modified_base (266)..(266): a, c, t, g, unknown or other
  misc_feature (266)..(266): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (444)..(444): a, c, t, g, unknown or other
  misc_feature (444)..(444): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagctataatntcggctggtgcgacacggcccctggacaaggacttgagtggatgggatggatcagcgnttacaatggtacaacaactatgacaacaanaaacctccgagggcagacgtcaccatcgaccanaacgacacatccacgagaccacacgaccctaacgagtacggagcgtaggacgggacnccgtagacgacttacgacgacgacgaccggtccgtaggtacttacgtgtgacggtagacggtcgtagctaggtcggcccggttaccgcccggtcgggaccgacggggacctcgg

SEQ ID NO: 317529 - DNA, 630 bp, Homo sapiens
  misc_feature: GZ8MTXP02IJY2H.21.61.F06.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagctataatatcggctgggtncgacaggcccctggacaaggacttgagtggatggatggatcgagcgcttaacaagttggttacaacaaactatagacaacaagaaacctccgaagggccaagacgtacacccagtacgaaccaacaacgacactaacaccaacgacgacaaccacgaccctaacagtacgggagaccgtaggaacgggacgacccgtaggaagacgttcgacggaccgaacgaccgggtccgttagtacgtttaacgtggtgcggtaagacggtacttaacggccgtaagggtccgggttccccgggttaccggtacccccgggtacgggggaccccggtaacgggggtaacccgttccgggg

SEQ ID NO: 317530 - DNA, 640 bp, Homo sapiens
  misc_feature: GZ8MTXP02HE90G.21.61.F06.1.454.CMB.2.raw
  modified_base (282)..(282): a, c, t, g, unknown or other
  misc_feature (282)..(282): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcaccttttaccagtctataatatcggctgggtncgacaggcccctggacaggacttggagtggatgggatggatcgagcgtacttacaatggttaacacaaactntgacacaagaaactccgagggcagagtacaccatcgaacacagacacacaccaacgagacaaccacgaccctaacacgtaggacgtcgtaggacggacgaccgtaggaacgtacgtacggtacggaaccgtaacggaccgggtaccggttaagttaacgtttaacggttcgggtacggacgggtaaggtacggttacgttacggaccggtacgggtcccggggtaccccggttacccggtacccccgggtcgggggaacccggtaacccggggtaaccccgttcgg

SEQ ID NO: 317531 - DNA, 611 bp, Homo sapiens
  misc_feature: GZ8MTXP02H6249.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggcttgagtggatggatggatcgagcgacttacaagtggttaacactaaaactatgacacagaaactccgagggcagatcaccatcgaccacaagacaacactaccacgagacaacacgaccctaacagtcgggaacgcgtaggaacgggacgccgtaggagtacgtcgacggaaccgaccgaccgggtaccgtagtaacttacgtggttacggaccgaaggacggtacgttaacgccgtaagggttcccggggtccccgggttaccgacccccggtcgggggaaccccgaacgggggtaacccccgttccgggg

SEQ ID NO: 317532 - DNA, 541 bp, Homo sapiens
  misc_feature: GZ8MTXP02GLSZY.21.61.F06.1.454.CMB.2.raw
  modified_base (278)..(278): a, c, t, g, unknown or other
  misc_feature (278)..(278): n is a, c, g, or t
  modified_base (472)..(472): a, c, t, g, unknown or other
  misc_feature (472)..(472): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcgagcgcttacaatggtacacaaactatgacacagaactccagggcagagtcacatgaccacagacacataccagagcaactacgacctaacagtacggagacctaggacggacgccgtagagactcgtgacgacacggccgtgtacttacgngtgacgagaggaccttaggctaggtcggcccggttacgaccccgtggggacccacggggaaccctcggg

SEQ ID NO: 317533 - DNA, 629 bp, Homo sapiens
  misc_feature: GZ8MTXP02F13N3.21.61.F06.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctggggcctnagtgaaggtctcctgcaaggtcttctggtttcacctttacagtctataatntcggctgggtncgacgacggcccctaggacaaggtcttggagtggagtggatggatcgagcgtacttacgaatggttaacaactaaactatacgacaacaacgaaactccggaagggccagacgtaccaaccagtacgaaccacaagaccaacactacccgaagacgacaccaacgccctaanagtacggacgaccgtagaacgggtacncccgtaagaacgtaacttcgacggaaccgtaacgaccgggtaccgttagttaacttacgtcggtacggacgtaaaggtcggtacgttacgcgtaaccggtccggtaccccggttaccgaccccggtgggacccgaacgggtacccttcggg

SEQ ID NO: 317534 - DNA, 636 bp, Homo sapiens
  misc_feature: GZ8MTXP02JTIUB.21.61.F06.1.454.CMB.2.raw
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagctataatatcggctgggtncgacaggcccctggacaaggacttggagtggatgggatggatcgagcgtacttanatgttaacacaaactatgacacaagaactccgagggcagagtccaccatcgaccacacgacacacaccacgagaccacacgacctaacagtcggagcgtaggacggtacgccgtaggacgacgttaccgagacccggaaccgtaccgggtaccgttagtaaacgtttaccgtcggtaggaccggtaggaacggtaccgtttaaacgggccggttaggggttcccggggtcccccgggtttaaccgggaaccccccggggttcgggggtaccccggaaaccggggttaaccccggtttcccgggg

SEQ ID NO: 317535 - DNA, 719 bp, Homo sapiens
  misc_feature: GZ8MTXP02HQEK3.21.61.F06.1.454.CMB.2.raw
  modified_base (217)..(217): a, c, t, g, unknown or other
  misc_feature (217)..(217): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggttcacctttaccagctataatagtcggctgggtgcgacacggcccctaggacaaggacttgagtggagtggatggatcgagcgtacttacgaagttaggttaacaaactaaaacttagtacgaccaacgaagaaaacctccgaaggggaccaaagggtaacgtaccgaaacctaagtaccgaaacccaaccgaaacgaaacctaaccaactaccccgaacgaacgaccaaaccgaacgaccctaaacagtacgggacgcgtagggaacggacgcccgtagggaagtacgttacgacggaaccggtaaccgaccgggtacccgttagttaacgtttacgtgggttacggacggaaacgggtacggtacgtttaacgggaccgtaacggggttccccggggtacccccgggttaccccggtaacccccgggtcgggggacccccggtaaaccgggggtaacccccgtttcccggggg

SEQ ID NO: 317536 - DNA, 621 bp, Homo sapiens
  misc_feature: GZ8MTXP02JZ24Z.21.61.F06.1.454.CMB.2.raw
  modified_base (400)..(400): a, c, t, g, unknown or other
  misc_feature (400)..(400): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctggaccaaggacttggagtggatgggatggatcgagcgtacttacgaattggttaacaactaaactatgacacaacgaaacctccgagggcagacgtacacatacgacanagacacactccagacgacacgacacctacagtaggacgcgtaggacggacgccgtaggaagtactaccgaggaaccggacgaccgggtaccgtagttacgttacgtggtacggaccggtaaggacggtaccgttaaggccgtaacgggggttcccgggtaccccgggttaccggacccccgggttcgggggaacccgtaccgggggtaaccccttccgggg

SEQ ID NO: 317537 - DNA, 647 bp, Homo sapiens
  misc_feature: GZ8MTXP02H3LZV.21.61.F06.1.454.CMB.2.raw
  modified_base (277)..(277): a, c, t, g, unknown or other
  misc_feature (277)..(277): n is a, c, g, or t
  modified_base (415)..(415): a, c, t, g, unknown or other
  misc_feature (415)..(415): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctatatatcggctgggtncgacacggcccctggacaaggacttgagtggatggatggatcagcgctttacaatggttaacactaaactatgacaacaagaaacctccgaaggcagactccaacatacgaccacagaaccaacactacccaacgganaccaaccgagaccctaacgagtggaacgtcgtaggaaggacggacccttagggacgtaagtccgtaggaaccggacgtaaccgggtccggttagttaacgtttaccgtggttacgacggtaaacgggaggttaccgtaaaggtccgtaacggggttcccgggtaccccgggtttacccggacccccgggttcggggggaaccccctaacgggggtaaacccccgttccgggg

SEQ ID NO: 317538 - DNA, 661 bp, Homo sapiens
  misc_feature: GZ8MTXP02IRZCY.21.61.F06.1.454.CMB.2.raw
  modified_base (216)..(216): a, c, t, g, unknown or other
  misc_feature (216)..(216): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctnagtgaaggtctctgcaggtcttctggtttcacctttaccagcttataatatcggctgggtgcgacgacggccccgtggaccaaggacttggagtgggatgggatggatcgagcgtacttaacaagttcggttaacaactaaactatacgacaacgaagaaactccgaagggaccagacgtaccaacccagtacgaaacccacaacgaaccacgacaccaacgacgaccacacgaccctaacagtacggaacgtcgtagggaaggacgccgtaaggaagtacgtcgtacggaccggaacggtcgggtacccgttagtaaacctttacggtggttacgggaccgtaaagggtacggttacgttaacgccgtaacgggggttccggacccccgggtttacgacccccggggttggggaccccgtaacggggtaaacccctttccgggg

SEQ ID NO: 317539 - DNA, 624 bp, Homo sapiens
  misc_feature: GZ8MTXP02H4B66.21.61.F06.1.454.CMB.2.raw
  modified_base (279)..(279): a, c, t, g, unknown or other
  misc_feature (279)..(279): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagctggggcctcagtgaaggtctcctgcaaggcttcgtggtttcacctttaccagctaataatatcggctgggtncgacacggcccctaggacaaggcttgagtggatgggatggatcgagcgtcgttaacaattcggttaaaccaactaaaactacgtagaccaaacgaaacgtaaaaccgtccgaaggggcaacggtaacgttacccgaacctaagacggaaacccaaacgaaaccgacaacgactacccgaacgaacgaaccaactacgaccctaacgagtacggagtcctagggacggtacgccgtaggacgtaatcgacgaacgacgaccggctagtactcnggtncgagacgtcgttagcgtacggtcggtcccggtaccgtacccggcggggaccgtacgggtaacccgtcgg

SEQ ID NO: 317540 - DNA, 601 bp, Homo sapiens
  misc_feature: GZ8MTXP02GNZSS.21.61.F06.1.454.CMB.2.raw
  modified_base (403)..(403): a, c, t, g, unknown or other
  misc_feature (403)..(403): n is a, c, g, or t
tcagtcgtcgctcgcacgaccggtgctcgatttagctacgctctaagggaaagggacccaaaccacaccctccttggaagaatccctagatcacagctcctcaccatggactggacctggagcatcctttcttggtggcagcagcaacaggtgcccactcccaggttcagatgatgcagtctggagctgaggtgaagaagcctggggcctcagtgaaggtctcctgcaaggcttctggtttcactttaccagctataatatcggctgggtgcgacaggcccctggacaaggacttgagtggatggatggatcagcgcttacaatggttacacaaactatgacacagaaactccagggcagagtcaccatcgaccacagacacactccacgagcacagccctanactggaagcctaggacggtaagcccgtaggacgtaacgtcgtacggaaccgacgaccggcccgtaggttaacttaaccgttggttacggtaccggaaggtaacgggtcctttaaggcccgtaaagggttcgggacccccgggtttaccggaacccccggttcgggggaccccgaacgggggtaacccctttccggggg

SEQ ID NO: 317541 - DNA, 609 bp, Homo sapiens
  misc_feature: GZ8MTXP02HW9W9.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtncgacacggcccctggaccaggacttgagtggatggatggatcgagcgcttaacaagttcggttaacaactaaaacttatacgacacaaggaaaactccgaaggggccagacgtacaaccgatcgaaccacagaaccacgacaccaacggaacaccaacacgaccctaacacgtggaactcgtaggaggacgccgtagacgtatcgtagaccgacaccggcgtagtacttacgtggtggacgaggacggtaccttaaggcgtaacggtccgggtcccggttaccggacccccggtagggggaccccgtacgggggtaaccccgttccgggg

SEQ ID NO: 317542 - DNA, 660 bp, Homo sapiens
  misc_feature: GZ8MTXP02FWT63.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacgacggccccgtaggacaaggacttgagtggagtgggatggatcgagcgacttacgaattcggttaacaaactaaaacttatacgtaccaaacgaaacgtaaaacctaccgaaacggggacaaacgggtacgtaacccgaaaccctaagtacgaaacccaacaaagaacccaaaccactacccgaaacggacgacaccaacgacccctaacaagtcggaacggtaccagggaacggacgcccgtaaggaagacttacgacggacgacgaccggtccgttagtaacttacgtgtggacgaggacgtacgttacgcgtacgggtcggtaccccgggttaccgaccccggggtcgggaaccgtacgggggaacccttccggg

SEQ ID NO: 317543 - DNA, 642 bp, Homo sapiens
  misc_feature: GZ8MTXP02JUVRW.21.61.F06.1.454.CMB.2.raw
  modified_base (543)..(543): a, c, t, g, unknown or other
  misc_feature (543)..(543): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctaataatatcggctgggtgcgacacggcccctggacaaggacttgagtggatgggatggatcgagcgcttaacgaagttggttaaccaacgtaaaactactagaccaacaagaaacctccgaagggcaagacgtccaaccatcgaaccacagaccacactcccgaacgagaccaacgacgaccctaacgacgtcgggaaacgccgtaagggacgggacgacccgtagggaagtacgtcgtacggaaccgacgacccgggtaccgttacgttaacgtttacgnggtggacggtaaaggcggtacgttacggcgtaacgggtccgggtccccgggttacccggaccccggttcgggggacccgtaacggggtaccccttcggg

SEQ ID NO: 317544 - DNA, 637 bp, Homo sapiens
  misc_feature: GZ8MTXP02IALTI.21.61.F06.1.454.CMB.2.raw
  modified_base (276)..(276): a, c, t, g, unknown or other
  misc_feature (276)..(276): n is a, c, g, or t
  modified_base (454)..(454): a, c, t, g, unknown or other
  misc_feature (454)..(454): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttctggtggcagcagcaacaggtgcccactcccaggttcagatgatgcagtctggagctgaggtgaagaagcctggggcctcagtgaaggtctcctgcaaggcttctggttcacctttaccagctataatatcggctgggtncgacacggcccctggacaaggacttgagtggatggatggatcgagcgtacttacaagtggttaacactaaaactatgacaacaggaaaactccgagggtccaggaagtccaaccgatacggaaccaacgaacgtaaccaactaactacccaacggaacactaaacacgacccaacganacggacgataggaagggtacgccgtagaagtagtcgtaacggaacgaccgaccggtccgtaagtaaactttaccggaggtacggacggtaaggtacggttacgtacggtaccggtacgggtcccgggtaccccggtacccggaccccgggtaccggggacccggtaccgggtaacccgtcggg

SEQ ID NO: 317545 - DNA, 649 bp, Homo sapiens
  misc_feature: GZ8MTXP02GL1KT.21.61.F06.1.454.CMB.2.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctnagtgaaggtctcctgcaaggcttctggtttcacctttaccagtctataatatcggctgggtncgacaggcccctggacaaggacttgagtggatgggatggatcgagcgacttacaagtggtacaactaaactntagaccaacaagaaacctccgaagggcaagacgtaccaccgaatcgaaccaacaagaacaaccatacccaacgagaccaaccagacccctaanagtaggacgcgtaggacggacgtaccgaggacgtacgtacgtacggaaccgaaccgaccgggtaccgttagttaacgtttacggtaggtacggaacggtaaggacggttacgttaacggcggtaccggggtcccgggttacccccgggttacccggacccccggggtacgggggtaaccccggtaaccggggtaaccccggtcgg

SEQ ID NO: 317546 - DNA, 548 bp, Homo sapiens
  misc_feature: GZ8MTXP02FTR6Q.21.61.F06.1.454.CMB.2.raw
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggcttgagtggatggatggatcgagcgcttacaatggtacacaaactntgcacagaaactccgagggcagagtcaccatcgaccacagacacatccagagcacacgacctacagtggaacgtcgaggaacgggacgcccgtaggaacgaactcgtagaccgacgaacggccgtagtacttacgtgtgcgagacggcttagcgtagtcgggacccgttcggacccccgtggggacccacgggtaacccgtcgg

SEQ ID NO: 317547 - DNA, 685 bp, Homo sapiens
  misc_feature: GZ8MTXP02IRL8F.21.61.F06.1.454.CMB.2.raw
  modified_base (407)..(407): a, c, t, g, unknown or other
  misc_feature (407)..(407): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctgtttcacctttaccagctataatatcggctgggtgcgacacggcccctggacaaggacttggagtggatgggatggatcgagcgcttacgaatggttaacaactaaactatcgaccaacgaacgaaactccgagggcaggacgtccaaccgatacgaacccaanacgaaccaacactacccgaacgacgaccaaccgtaacgacccctaaacgagttacgggaacgtaccgtagggaacgggaacgcccgttaggaacgtacgttacgtacggaaccggaaccgaccggggtaccgttaggttaacgtttaaccgtggtacggtacggaggtaacgggtcgtttaaacgggcgttaacggggttccgggtacccccgggtttacccgggacccccgggttacgggggacccccgtaaacgggggtacccccgtttaccgggg

SEQ ID NO: 317548 - DNA, 603 bp, Homo sapiens
  misc_feature: GZ8MTXP02JPEFX.21.61.F06.1.454.CMB.2.raw
  modified_base (277)..(277): a, c, t, g, unknown or other
  misc_feature (277)..(277): n is a, c, g, or t
  modified_base (345)..(345): a, c, t, g, unknown or other
  misc_feature (345)..(345): n is a, c, g, or t
  modified_base (384)..(384): a, c, t, g, unknown or other
  misc_feature (384)..(384): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtncgacaggcccctggacaggacttgagtggatggatggatcgagcgcttacaatggttacactaaactntgacaacagaaactcgaagggcagagtccacatgaccanagactacatccacgacgcacagtcccacagtggacgctaggacggagccctaggagacgttcgacggaaccgacaaccggggtccgttaggtaactttaaccggtggttacggacggtaagggacgggtccgtttaaggccgtaagggtccggggtacccccggtttcgggaaccccccggtgggggacccccggaacggggtaacccccgttccgggg

SEQ ID NO: 317549 - DNA, 598 bp, Homo sapiens
  misc_feature: GZ8MTXP02HPMD0.21.61.F06.1.454.CMB.2.raw
  modified_base (192)..(192): a, c, t, g, unknown or other
  misc_feature (192)..(192): n is a, c, g, or t
  modified_base (276)..(276): a, c, t, g, unknown or other
  misc_feature (276)..(276): n is a, c, g, or t
  modified_base (484)..(484): a, c, t, g, unknown or other
  misc_feature (484)..(484): n is a, c, g, or t
  modified_base (526)..(526): a, c, t, g, unknown or other
  misc_feature (526)..(526): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctggggcctcagtgaagtctcctgcaaggcttctggttcacctttaccagctataatatcggctgggtncgacacggcccctggacaaggacttgagtggatgggatggatcgagcgacttaacgaagttggttaacaactaaaactatacgacaacaagtaaaacctccgaaaggggccaaagggactaccaaccctatacggaaacccaacgaagaaccaactacacccaacgacgacaaccgacgaccctaacagtaggaagcgtaggaggacnccagagacgtcgacgacgacgaaccggccgtagtacttacgngtagacgagaggtactagacgaggtccggtcccggtaccgaccccggtgggacccaacggggtaaccctcgg

SEQ ID NO: 317550 - DNA, 653 bp, Homo sapiens
  misc_feature: GZ8MTXP02HNF4F.21.61.F06.1.454.CMB.2.raw
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacacggcccctggacaaggacttgagtggatgggatggatcgagcgtacttanaagttggtaacactaaactatacgacacaacgaaactccgagggcagagtacacatcgacacanacacactacacgagacacacgacctacgagtaggacgtccgtaggacgggagacccgttagggaaacgtacgttaccgaaggaacccggtaacgacccggggttcccgttagttaacgtttaaccggtggttacggaccgggtaaaggtacgggtacgtttaacggccgttaacggggtcccggggtcccccggtttacccggggacccccggtacgggggtaccccgaaccgggggttaaccccggttccgggg

SEQ ID NO: 317551 - DNA, 602 bp, Homo sapiens
  misc_feature: GZ8MTXP02JZTC2.21.61.F06.1.454.CMB.2.raw
  modified_base (278)..(278): a, c, t, g, unknown or other
  misc_feature (278)..(278): n is a, c, g, or t
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacacggcccctggacaaggcttgagtggatgggatggatcagcgcttacatggttacacaaactntgcacagaactccgagggcagagtcacatacgaccanagacacactaccagacgcacacgcctaacagtggacgctaggacggacgccctaggacgatcgtaggaaccgacgaccgggtaccgttagtaacgtttaaccgtggtacggaccggtaaggtacgggtacgttacggaccgtaacgggtccggggtcccccgggtttaccggacccccgggttcgggggaccccgtaacgggggaaccccgtttccgggg

SEQ ID NO: 317552 - DNA, 587 bp, Homo sapiens
  misc_feature: GZ8MTXP02FOEDY.21.61.F06.1.454.CMB.2.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagccgtggggcctcagtgaaggtctcctgcaaggcttctggtttccacctttaccagtctataaatntcggctgggtncgacncggcccctggaccaaggcttggagtggatgggatggatcgagcgtacttacgaagtggttaacaactaaaactntacgaccaacaacgaaactccgaaggggcaagacgtacaccatacgaccanagactaacacaccgagacgactacacgacctacgagtggaancgtaggacggcgcctaggagtactcgagaccgacgaccgtcgttagtaacttcgtgtgacgaggtacgcttaggcgtagggtccggtacccggttccgacccgggtcggggaccgtacgggtacccgttcggg

SEQ ID NO: 317553 - DNA, 660 bp, Homo sapiens
  misc_feature: GZ8MTXP02HAYUH.21.61.F06.1.454.CMB.2.raw
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (543)..(543): a, c, t, g, unknown or other
  misc_feature (543)..(543): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcaaggcttctggttcacctttacagtctataatatcggctgggtgcgacacggccccctaggacaaggcttggagtggatgggatggatgagcgtacttaacaagtggttaacaaactaaactatacgacaacgaaacgtaaacgtcccgaagggcaagacgtaccaacctagacgaaaccacaacgaccaacactacccgaagaacgaccaaccgacgtaaccccgtaanagtaggacgtacgtaggacgggacnccgtagaacgnttacgacgaccgtaacgaccgggtccgttagtacgtttaaccgnggttcggaccggtaagacgggttacgttaacggcgttaacggggtcccgggtaccccggtttacccgggaccccggttagggggaccccgtaaaccggggtaaccccgtttcccggg

SEQ ID NO: 317554 - DNA, 648 bp, Homo sapiens
  misc_feature: GZ8MTXP02HU4D0.21.61.F06.1.454.CMB.2.raw
  modified_base (451)..(451): a, c, t, g, unknown or other
  misc_feature (451)..(451): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagtctataatatcggctgggtgcgacacggcccctggacaaggacttgagtggagtgggatggatcgagcgtacttacaagtaggttaaccaactaaactatacgacctaacaacgaactcccgagggcagacgtaccaccagtacgaccacgaagaaccaacactacccacgacgaccaactacgaccctanagtaggacgtcgtaggacggaacgccgtaggacgtacgtccgtaggaaccgaccggacggtcccggttagttacgttacgtaggttcggacggtaggtacgggtcgtttaacggccgtagggttcccggggtcccccgggttaccggtacccccggggtcgggggaacccccgtacgggggtaaccccgttccgggg

SEQ ID NO: 317555 - DNA, 660 bp, Homo sapiens
  misc_feature: GZ8MTXP02HNP9T.21.61.F06.1.454.CMB.2.raw
  modified_base (278)..(278): a, c, t, g, unknown or other
  misc_feature (278)..(278): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaggacttgagtggatgggatggatcgagcgacttacaattggttacacaaactatcgacacagaaactccagggcagacgtacaccagtacgaccacaacgaccaaacactaccaacgacgaccaacacgaccctanagtacggagccgtggaacggacgaccgtaggaagtacgttaccgtacggaaccggtaccgaaccggggtacccgttaggttaacgtttaacgttgggttacggacgggtaagggtaacggtcgtttaaacggccggtaacgggttcccggggtacccccggggtttacccggaccccccgggggttagggggacccccggtaacgggggtaacccccggtttcccgggg

SEQ ID NO: 317556 - DNA, 654 bp, Homo sapiens
  misc_feature: GZ8MTXP02GMNPU.21.61.F06.1.454.CMB.2.raw
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctctgcaggcttctggttcacctttacagtctataatntcggctgggtncgacacggcccctaggacaaggcttggagtggagtgggatggatcgagcgtacttaanaagttgtaacaaactaaaactatagacctaaacgaacgtaaacctaccggaaggggtcaacggtaacgtaccaaccgtaagacgaaacccaaacgagaaccaaacacgtacccgaacgacgaccaacgacgtacctaacgagcggacgacgtaggacggacgtaccgtagggaacgtactacggaggaaccgtacggacggtaccgtagttacttacggtgtcggacggaaggtacggtccttaaggccgtaacggggtccggtaccccggttaccggaccccggggtggggaacccgtaccggggtaacccgttccggg

SEQ ID NO: 317557 - DNA, 682 bp, Homo sapiens
  misc_feature: GZ8MTXP02GI7Y9.21.61.F06.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctctgcaggcttntggtttcacctttaccagctataatntcggctgggtgcgacacggcccctaggacaaggacttggagtggagtgggatggaatcgaggtcgtacttaacgaagttggttaaacaactaaaacttagtgaaccaacgaaaggaaaacctcccgaaggggccaaggaacgttaccaaccctaagtcgaaacccaacaacgaccaactacacccaacgacgaccacaacgaccctaacgagtacgggaagtcgtaaggacgggacgacccttagggaacgtaactcgtacggaaccgacgtaccggaccgtagttaacttacgtcggtacggaccgtaaggaacggggttacttaaacggccgtaacggggtccggggtacccccggttaccgggtaaccccccggttcgggggaccccgtaaccggggaacccccgtttcgggg

SEQ ID NO: 317558 - DNA, 598 bp, Homo sapiens
  misc_feature: GZ8MTXP02GNJNX.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttcgtggtttcctacctttaccagctaataatagtcggctagggtgcgacgacggcccctaggacaaggacttggagtggagtggggatggatcgagcgtacttaacaagttggttaacaacgtaaaactacgtagacaacgaagaaacctccgaagggcaaggacgtacaaccgatacgaaccaaacacgaacaacacaccgaacgagaccactacgaccacagacggagacgagacggacgccgtagagatcgtagacgtacgacgcgtagtacttcgtgtagacgagtacggtacgtagcgtaggtccggcccggttaccggacccgggtggaccccggtacgggtacccgtccgg

SEQ ID NO: 317559 - DNA, 654 bp, Homo sapiens
  misc_feature: GZ8MTXP02GX4XA.21.61.F06.1.454.CMB.2.raw
  modified_base (483)..(483): a, c, t, g, unknown or other
  misc_feature (483)..(483): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagctataatatcggctgggtgcgacgacggcccctaggacaaggcttggagtggatgggatggatcgagcgtacttaacgaaagtcggttaacaaacgtaaaactagtagacctaacgaaacgaaacctcccgaggggaccaggaacgtaccaaccaatacgaaacccaacgaacgaccaactacacccaacgacgaccaaccgacgaccctaacgagtcgggaacncgtaggaacggacgccgtaggaagtacgtcgtacggaccgaacgaccgggtaccgtagtaacttacgtggtcgacggaggtacggtcgttaacggcgtaacggtccgggtacccccggttaccggacccccggtagggggtaccccgaacgggggtaacccccgttcgggg

SEQ ID NO: 317560 - DNA, 633 bp, Homo sapiens
  misc_feature: GZ8MTXP02FRQOJ.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatggatggatcgagcgcttacgaatggtacacaaactatgcaacacgaaactccgaagggcaagacgtacaccatacgaaccacacgacaacactaccaacgagaccaacgacgacctaacgatacgggaacgcgtaggaggaacgtccgtaggacgactcgtacgaaccgaacggaccgggtaccgtgggttaactttacgtgggttacggccggtaaaggtacggtacgtttaacggccggtaacgggtccggggttacccccggggttaccggacccccggggttagggggaccccgaaccgggggaacccctttccggggg

SEQ ID NO: 317561 - DNA, 608 bp, Homo sapiens
  misc_feature: GZ8MTXP02F6P19.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatggatggatcgagcgcttaacaatggttaacaacgaaactatgacacaagaaactccgaagggccaagacgtcaaccgatacgaccacagaacacactccaacgagactaacacgacctaacgatcggagtcgtaggagggacgccgtaggaacgtacgtccgtaggaacccgaacgacgggtcccgtagttaactttacgtggtcgaccggtaaaggacggtcgttaaacgcgtaaggtccggtaccccgggttacgaacccccggtgggggacccgtaccggggtaacccttccggg

SEQ ID NO: 317562 - DNA, 549 bp, Homo sapiens
  misc_feature: GZ8MTXP02FGDAK.21.61.F06.1.454.CMB.2.raw
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacaggcccctggacaggcttgagtggatgggatggatcagcgcttacaattggtacacaaactatgacacagaaactccgagggcagacgtcaccgatcgaccacagacacatccacgagcacagacctacatggagcgngaggagcctagagactcgacgacgacgacggccgtagtacgttacgngtggacggaggacggacgttacgcgtacggtcgggtcccggttaccggaccccggtcggggacccgacgggtacccgtcgg

SEQ ID NO: 317563 - DNA, 711 bp, Homo sapiens
  misc_feature: GZ8MTXP02IO7FW.21.61.F06.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctnagtgaaggtctcctgcaggcttntgttcncctttacagctatatatcggctgggtncgacgacggccccctaggacaaggacgttgagtgggagtgggatggatcgagtccgtcttaacgaagttggttaaccaaactaaaccttagtacgacctaacaaacgtaaaactcccggaaaggggccagggtaacgtaccaaacccgacgttaacggaacccgaaacaaccgaaactaaacccgactaacccgaacggaaccgaccaaacccgacgtaccccctaaacgagtacggaacgaccgttaggaacgggacgcccgttaggaaccggtatcgtacggaccgtaacggacggtaccgtggtaaaaccttttgacgggttggacggtaaaggtacggtacttaacggacggttacgggtccggggttaccccggttcccgggaacccccggggtgggggaccccggtaaacgggggtacccctttccgggg

SEQ ID NO: 317564 - DNA, 561 bp, Homo sapiens
  misc_feature: GZ8MTXP02FZ7D2.21.61.F06.1.454.CMB.2.raw
  modified_base (329)..(329): a, c, t, g, unknown or other
  misc_feature (329)..(329): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacaggcccctggacaaggacttgagtggatggatggatcagcgcttanaatggtacacaaactatgacacaagaaactcgaaggcagacgtacaccatacgaccacagacacatccacgagacacacgcctacatgagcgtgaggngcctgagagtctagacgacgacggccgtagtacttactcggtgacggaggtacggtacttacggcgtacgggtcgggtcccccggttacggacccccggtcgggggtacccggaccggggtaacccgtaccggg

SEQ ID NO: 317565 - DNA, 668 bp, Homo sapiens
  misc_feature: GZ8MTXP02IEP10.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaagcttctggttcacctttaccagtctaataatatcggctgggtgcgacacggcccctaggacaaggcttggagtggatgggatggatcgagtcgtacttaacgaagttggttaaccaaactaaaacgtactaggaccaacgaaagtaaaaccgtccgaaggggccaaggaacgtaccaaccaatcgaaacccaacaaacgaacccaacaacctacccgaacggaacgacccaaaccgtaacgacccctaaacgagtacgggaacgcgtagggaacggacgccgtaggacgactcgagaaccgacgaaccggtccgttagtaacttcgagtcggacgtaaggacggtccgttaagccgtacgggtaaccgggtcccccggtttaccggacccccggtacgggggtaccccgaaccgggggtaaccccttccgggg

SEQ ID NO: 317566 - DNA, 736 bp, Homo sapiens
  misc_feature: GZ8MTXP02GWKJ2.21.61.F06.1.454.CMB.2.raw
  modified_base (282)..(282): a, c, t, g, unknown or other
  misc_feature (282)..(282): n is a, c, g, or t
  modified_base (498)..(498): a, c, t, g, unknown or other
  misc_feature (498)..(498): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagtctaataatagtcggctgggtncgacgacggcccctggacaggtacttggagtggatggggatggatcgaggcgtacttaacaagttacggttaaaccaaactaaaacttacgtacgaaccaaacgaaacgtaaaaccgtaccggaacgggaccgaagtaacggtacccaaaccgtaagtaccgaaacccaacgaaacgaaccaacactaccgaacgacgacaaccgactaccctaanaggagacgacgtagggaaggtacgccgttaggaacgacgttaccgacggaaccgaacccggtaccgggttaccgttaacggtttaacgttaccggttagggtacggaccgggtaaagggttaccgggttacttaacggggaccgttaacggggtcccgggggttcccccggttaacccgggacccccgggggttacgggggtaccccggtaacccggggtaaaccccgtttcccgggg

SEQ ID NO: 317567 - DNA, 660 bp, Homo sapiens
  misc_feature: GZ8MTXP02F1RQC.21.61.F06.1.454.CMB.2.raw
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
  modified_base (466)..(466): a, c, t, g, unknown or other
  misc_feature (466)..(466): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagctaataatatcggctgggtncgacaggcccctggacaaggtacttggaagtggatgggatggatcgagcgcttaacaagttggttaacaacgtaaaactntacgacaacaagaaacctccgaagggcagacgtcaaccatacgaccacaagactacactaccacgacgacaacacgacctaacgagtacggaagtcgagacgggancccgtaggagtacacgtacggaacgaccgaccgggtaccgttagttaaacgtttacgtcgggttacggaccgggtaaaggtaccgggtacgttaacggcccgttaaacggggtcccgggttacccccgggggtttaccccggaccccgggttacgggggacccgtaaccgggggtaaacccccgtttccggggg

SEQ ID NO: 317568 - DNA, 687 bp, Homo sapiens
  misc_feature: GZ8MTXP02FM8GO.21.61.F06.1.454.CMB.2.raw
  modified_base (275)..(275): a, c, t, g, unknown or other
  misc_feature (275)..(275): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctctgacaggcttcgtggtttcacctttacagtctaataatagtcggngtgggtgcgacgacggtccccgtggacaacggtcttggaggtggagtggggatggatcgagtccgtacttaacgtaagttaggttaaaccaacgtaaaactacgtacgacaaacgaagtaaaccctccggaagggacctaagggacttacaacccgagtacgaaccaacacgaacaacgtacaccgaacgacgaccacgacgaccctaagagtacggagccgtaggacggactcctagggaagtactcggtaggaacccgaccgtaacgggtccgtttaagtaacttcggcggtacggacggtaaacggtcggtaccgttacggaccggttacggggtccccgggttaaccccggttacccgggaccccggggtttccggggacccggtaaaccgggttaccccgtcccggg

SEQ ID NO: 317569 - DNA, 601 bp, Homo sapiens
  misc_feature: GZ8MTXP02FVYRU.21.61.F06.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcaggtcttcgtgtttcacctttacagtctataatntcggcgtgggtcncgacacggcccctaggacaaggtctggagtggagtggatggactcgagcgtacttaacgaagttacggtaacaaactaaaactacgtacgaccaaacgaacgaaaccgtccgaaggggcaagtacgtaccaaccgatacgaccaacgacacacactccaacganacaacacgacctacgagtagganacgtaggacggcgacgtaggaagtactcgaacgaccggaacgcggtctagtactacggtgaggacgacggagtcctaacggcgtacgggtcggtccccggtacgacccgggtcggaccgtacgggtaccctcgg

SEQ ID NO: 317570 - DNA, 626 bp, Homo sapiens
  misc_feature: GZ8MTXP02JUKOR.21.61.F06.1.454.CMB.2.raw
  modified_base (396)..(396): a, c, t, g, unknown or other
  misc_feature (396)..(396): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctggacaggacttgagtggatgggatggatcagcgcttaacattggtacaacaaactatgacacagaactccgagggcagagtcacatacgacaacagactacgacnccagacacaacgactacctaacagtacggaagtccgaggacggtaacgcctagggaaacgtacgtacggtaacggaccggaaccgaccggttacgttaacgttaacgtttacggtcggtacggacggtaacggtacggtaccgtacggccggtaccgggtcccggggtacccccgggtttacccggacccccggggtacgggggaccccgtaccggggtaacccgttcgg

SEQ ID NO: 317571 - DNA, 664 bp, Homo sapiens
  misc_feature: GZ8MTXP02HAKD1.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagtctaataatatcggctgggtncgacacggcccctggacaggacttgagtggatgggatggatcgagcgtactttaacgaagttacgggttaacaacgtaaaactatacgaccaacgaacggaaaacctcccgaaaggggccaaaggtacggtaccaacccgaatacggaaacccaacgaacgaacctaaacaacacccgaacgaaccgacaaccgacgaccctaacgagtcgggaaacgccgttaggacgggagacccgtaggaacgagtccgaggaaccggacgaaccgggtccgttagtaacgttacgtggtaggacggtagagggtaccttaggcgtaagggtccggtaccccggttaccggaccccgggtggggaccccgtaacggggtaccccgttcgggg

SEQ ID NO: 317572 - DNA, 689 bp, Homo sapiens
  misc_feature: GZ8MTXP02HE3QB.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacacggcccctggacaaggacttgagtggatgggatggatcgagcgcttaacatggttacactaaactactgacctaacaacgaaacctccgaagggtcaaggtaacgtaccgaacctaacgacggaaaccccaaacgaaacgaaccaaccaactaccccgaaacgaacgacccaaccgtaacggacccttaacgacgtacgggacgtaccgtagggaaacgggtacgcccgttaggaacgacgttaccggtacggaaccgacgtacccgggttaccgtagttacgtttaacgtggtaccggagtacgggaaacgttcgttaacggcgttaacgggtccggggtaccccggtttaccggaacccccgggttcgggggaccccgtaaacgggggttaaccccgtccgggg

SEQ ID NO: 317573 - DNA, 629 bp, Homo sapiens
  misc_feature: GZ8MTXP02H5AT2.21.61.F06.1.454.CMB.2.raw
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctctgcaaggtcttctggtttctacctttaccagtctaataatagtcggctgggtgcgacgacggcccctaggacaaggtcttggagtggagtggatggatcgaggcgtacttaacaagttaggttaaccaaactaaaactatagaccaaacaacgaaacctccggaagggcaaggacgtaccaaccagtacgaacccanaacgacacactacccgaagacgaccacgacgtacctaaacgngtaggacgcgtagggacggtacgccgtaggacgtactcgaggaaccgacggaccggtcgtagttacttacgtggtacggtcgaaggtacgtcgttacgcgtacggtccggtaccccggtacggacccccggtggggaccccgtacggggaaccccttcggg

SEQ ID NO: 317574 - DNA, 667 bp, Homo sapiens
  misc_feature: GZ8MTXP02JXQS0.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggagtgggatggatcgagcgtacttacgaattggttaaccaacgtaaaactagtacgactaacgaacgtaaaacctcccgaaggggccagaacggttacccaaccgaagttcgaaacccaacgaacgaacccaacaactacccgaacgaacgaccaaaccgacgtaccctaacgacgtggaacgcgttaggacggacgccgtagggagtaactcgtagaccgacgtaccgggccgttagtacgtttacgtggtacgacggaggtacggtacgtttacggacgtagggttccgggtcccccgggtttaccggacccccggttacgggggaccccgtaaccgggggtaaccccgttcccgggg

SEQ ID NO: 317575 - DNA, 644 bp, Homo sapiens
  misc_feature: GZ8MTXP02HZK9W.21.61.F06.1.454.CMB.2.raw
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagcctggggcctcagtgaaggtcncctgcaaggcttctggtttcacctttaccagtctataatatcggctgggtncgacacggcccctggaaccaaggacttggagtggatggggatggatcgagcgtcttaacaagtggttaaccaactaaactatgaccaacaaacgtaaactacccgaagggccaagacgtaccaccaatcgaaccaacganaactacaatccaacgaacnccaactacgaccctaagagtacggaagtccgagacgggacgtaccagggatacgttacgacggaccgtaacggaccggacggttacgtttaaactttagcgggttacggaggaaaccgggtaggtccgttaaaggccgtagggtcccgggttccccggttaccggaccccggtgggggtaacccccacggggtaacccgtccggg

SEQ ID NO: 317576 - DNA, 654 bp, Homo sapiens
  misc_feature: GZ8MTXP02FXXVU.21.61.F06.1.454.CMB.2.raw
  modified_base (282)..(282): a, c, t, g, unknown or other
  misc_feature (282)..(282): n is a, c, g, or t
  modified_base (559)..(559): a, c, t, g, unknown or other
  misc_feature (559)..(559): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttccacctttacagtctaataatagtcgcgtgggtncggacacggcccctaggacgaaggtcttgaggtggatgggatggatcgagcgtacttaacgaagttggtaacaactaaaactatacgaccaacgtaaacgaaaacgtcccggaagggctaacggacgtacaacccgtatacgaccaagaacgactacacgtaccaacgacgacaaccgacgacccttagacgtcggacgacgttggacggaagaccgtaggaacgtacgttacgacggaaccggaacgtaccgggtaccgtagttaacgtttacggnggtacggacggtacggtaacgtacgtacgacggtacggtcccgggtaccccggtaccgggtacccggacggggtacccggtaccggtaccgtcgg

SEQ ID NO: 317577 - DNA, 633 bp, Homo sapiens
  misc_feature: GZ8MTXP02IR8YS.21.61.F06.1.454.CMB.2.raw
  modified_base (192)..(192): a, c, t, g, unknown or other
  misc_feature (192)..(192): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctggggcctcagtgaaggtctcctgcaaggcttctggtttcacctttaccagctataatatcggctgggtncgacaggcccctggacaaggcttgagtggatggatggatcagcgcttacatggtacacaaactntgcanagaactcagggcagatcaccatgaaccanacgacacactaccacgagacacacgacctacacgtggaacgcgtaggacggagccctaggacgaattcgacgaaccgaacgaccgggacccgttagtaacgtttaaccgtggttacgggacccgtaaagggtaacgggttaccgtttaagggaccgtaaacggggttcccggggtacccccggggttttaccggaacccccccgggttaggggggacccccgtaaaaccggggggtaaacccccgtttacccggggg

SEQ ID NO: 317578 - DNA, 681 bp, Homo sapiens
  misc_feature: GZ8MTXP02HKJ8R.21.61.F06.1.454.CMB.2.raw
tcagtcgtcgctcgcacgaccggtgctcgatttagctacgctctaagggaaaggggacccaaaaaccacacccctccttggaagaatcccctagatcacagcttctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctggacaaggacttgagtggagtggatggatcgagcgcttacaaatggttaacaactaaactatacgacaacaacgtaaacctaccgaagggcctaaggaacgttaccaaaccccgtaagtaccggaaacccaacgaaacgaccaaaccgtaacacccgaaacgaacgaccaaccgaacgaccccttaaagagtacgggaacgaccgttaggaaacgggtacgacccttaggggaactaacgttaccgacggaacccgaaccggacccgggtaccgttagttaacgttaacgtggtacggacggagtacgggtacttacggaccgtaggtccgggtaccccggttaccggaccccggttggggacccgtaaccggggtaaccccgttccggg

SEQ ID NO: 317579 - DNA, 606 bp, Homo sapiens
  misc_feature: GZ8MTXP02JR3WF.21.61.F06.1.454.CMB.2.raw
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgcaggcttctggtttcacctttaccagctatatatcggctgggtncgacgacggcccctaggacaaggcttggagtggagtgggatggatcgagcgtattacgaagtcggttaacaactaaactactcgaccaacgaacgtaaacgtccgagggtcaaggtacgtaccaaccgataccgacacacgacacctanacccgagacgacaactacgacctaacgagcggatcgaggacgcgacgtgagacgttgacggaacgacggaccggtacgtacgttactacgtgggctacggaggtcgtacgtacgacgtacgggtccggttaccccggtaccggaccggtacggggaccccgtaacgggtacccgtccggg

SEQ ID NO: 317580 - DNA, 582 bp, Homo sapiens
  misc_feature: GZ8MTXP02FQZU1.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcgagcgacttacaatggttaacaactaaactatgcaacaagaaaacctccgaaggggcaagacgtcaaccatacgaccaacagaacacactaccaacgagacaacacgaccctacgagtggagcgtaggaggagccgtagagatcgagacgacaacggcgtagtacttacgtgtacgcgaggacggtcttaacgcgtaacggtccggtaccccgggtttacgaacccccggtgggggaccccaacgggggtaaccccttcggg

SEQ ID NO: 317581 - DNA, 616 bp, Homo sapiens
  misc_feature: GZ8MTXP02FO5D8.21.61.F06.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtncgacaggcccctggacaaggacttgagtggatgggatggatcagcgcttacaatggtaacacaaactatcgacacagaaactccgagggcagacgtcaccatcgaccacagacaacataccaacgagacacacgaccctacagtggaagcgtaggaggacgcccgtaggaacgtactcgtacggaaccgacgaccgggtccgttagtaacttaaccgtggtaggaccggaaggtacgggtacctttaaggccgttaacggggtccgggtacccccggggtttaccggaacccccgggttcgggggaaccccggtaacgggggtaaccccgttccgggg

SEQ ID NO: 317582 - DNA, 730 bp, Homo sapiens
  misc_feature: GZ8MTXP02GM0GV.21.61.F06.1.454.CMB.2.raw
  modified_base (288)..(288): a, c, t, g, unknown or other
  misc_feature (288)..(288): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgccccactcccaggttcagatgatgcagtctggagctgaggtgaagaagccgtggggcctcagtgaaggtctccgtgacaaggtcttcgtggtttccacctttaccagtctaataatagtcggctgggtncgacacggcccctaggacaaggcttggagtggatggatggatcgagccgtattaacgagttaggttaaccaaacgtaaactcgtagaccaaacgaacggtaaaacctcccggaaggggccaagggtacgtaccaccagtacgaacccaacgaacgaccaacgacacccgaacgacgaccaaccgtacgtacccctaagagtacggaacgtccgtaaagggaacggacgaccctagggtaacgtaacgttaccggacggaaaccggaaccgtaccgggttacccgttaagtttaacgtttaaccgtgggttacggaccgggtaaggtacgggttacgttaacggaccgtttaacggggtcccgggttacccccggggtttaaccggacccccggggtacgggggttaaccccgaaaccgggggtttaaccccgttccccgggg

SEQ ID NO: 317583 - DNA, 634 bp, Homo sapiens
  misc_feature: GZ8MTXP02F92VU.21.61.F06.1.454.CMB.2.raw
  modified_base (455)..(455): a, c, t, g, unknown or other
  misc_feature (455)..(455): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtgggcctgagtgaaggtctcctgcaaggcttcgtggtttcacctttaccagtactaataatatcggcgtgggtgcgacacggcccctaggacgaaggacttggagtggagtgggatggatcgagcgtacttaacgaagttaggtaacaaacgtaaactagtacgaccaacgaaagtaaacctaccgaagggcagacgtacaaccgatacgacaacagaacacacacacgagacaacacgacctanacgtggaaacgcgtaggaaggcgactaggagtaacgttcgaacggaaccgaacggtaccgggtaccgttagtaacgttacgtggtacggacgaggtacgggtcttaacgggcgtacgggtaacccggtccccggtacccggtacccgggtcgggaccggaaccggtacccgtttccggg

SEQ ID NO: 317584 - DNA, 644 bp, Homo sapiens
  misc_feature: GZ8MTXP02JXQAD.21.61.F06.1.454.CMB.2.raw
  modified_base (460)..(460): a, c, t, g, unknown or other
  misc_feature (460)..(460): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggtttcacctttaccagctataatatcggctgggtgcgacacggcccctaggacaaggacttgagtggagtggatggatcgagcgacttacaagtcggttaacaacgtaaactagtacgacaacaacgaaaacctccgaaggggccaaggaacgtccaacccagtacgaaaccacgaagaccaacacgaccaacgaacgacaacgacgtaccctaanacgttacgggaaagtcctagggacggtacgacctggaacgtatccgtacggaaccgacgtaccggcgttagtaaccgttagtcggtaggacggtaacggacgtacgttacggacgtacggtccgggtacccccgggtttccgaacccgggttcggggacccgaaccgggggtacccttaccggg

SEQ ID NO: 317585 - DNA, 670 bp, Homo sapiens
  misc_feature: GZ8MTXP02G117C.21.61.F06.1.454.CMB.2.raw
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcacctttaccagtctataatatcggctgggtncgacacggcccctggacaggacttgagtggagtggatggatcgagcgtacttaacagtaggttaacaacgtaaaactacgtacgactaacaacgaaaccttaccgaagggcctaaggacgtaccaaccagtacgaaccacgaacgaccaacacacccgaagacgacaaccgacgtaaccctacgagcgggaagtccgtaggacggacgcccgtaggaacgtacgtccgaacgggaccgtaacggacccgggtaccgttagtaacgtttaccgttagggcgtacgggaaggtacggtacgttaacgggctacgggggtcccggtcccccgggttaaccgggtaccccgggacgggggtaccctaaccgggggtaaccccgtttcccgggg

SEQ ID NO: 317586 - DNA, 608 bp, Homo sapiens
  misc_feature: GZ8MTXP02F6QFP.21.61.F06.1.454.CMB.2.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagtctataatatcggntgggtncgacaggcccctggacaaggcttgagtggatgggatggatcagcgcttaacgaattcggtaacacgaaaactntagacaacgagtaaactcccgaaggggccagaacgtcaccgatacgaccanaacgacaacactaccaacgacgaccaacgacgacccttaacacgtggaaacgtccgtagggaacgggacgtacccgttagggaacgtactacgtacggaaccggacgaccgggtaccgtagttacttaacgtgtggacgaggtacggtcgttaagcgtaggtccggcccgttcggaccccggtggggacccacggggtaccctcgg

SEQ ID NO: 317587 - DNA, 690 bp, Homo sapiens
  misc_feature: GZ8MTXP02F2M8G.21.61.F06.1.454.CMB.2.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctgtttcacctttaccagctataatntcggctgggtncgacgacggcccctaggacaaggacttgagtggatggatggatcagcgcttaacaatggttaacaactaaaactgtagacaacaacgaaactccgaaggggcaaggacgtaccaaccatacgaacccaacgaagaaccaacaactaccgaacgaacgacaaccgaacgtacctaaccgagtacgggaaacgtaccgaggaaacgggaccgtaccgttagggaaacgtaacgttaccgaacggaacccggaaacggtacccgggtaccgttaggtaaacctttacggtggtacggaccggaaacggtaggtacccgtttaaaggccggtaaacggtccggggtacccccggtttacccgggaaacccccgggttcgggggaccccgtaacgggggtaacccccgtttacgggg

SEQ ID NO: 317588 - DNA, 777 bp, Homo sapiens
  misc_feature: GZ8MTXP02JWWNC.21.61.F06.1.454.CMB.2.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttcgtggtttcacctttaccagtctataatatcggntgggtncgacacggcccctggacaaggacttggagtggatggggatggatcgacggcgtacttaacgaagttacggttaacaaactaaaacttactacgaccaaacgaaacgtaaaccgtccggaagggccgaacggaacgttaccaaccgtagtaccggaaacccaaaccgaaacgaaccaaaccctaactacccgaacgaaccgacaaacccgacgaccctaaccgaagtcggaagtccgtaagggaagggaccgtaccgttagggaacgtacgttaccggtacggaaccggaccgtaccggggtacccgtttaggttaacgtttaaccgtgggtttacggaccggtaagggtaaacgggtacccggtttaacggaaccggttaaccgggggttccccgggggttaccccccggggtttaaccccgggggtaccccccgggttaccgggggggaaccccccgttaaaacccggggggttaacccccgtttacccccggggg

SEQ ID NO: 317589 - DNA, 580 bp, Homo sapiens
  misc_feature: GZ8MTXP02GIEID.21.61.F06.1.454.CMB.2.raw
  modified_base (391)..(391): a, c, t, g, unknown or other
  misc_feature (391)..(391): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctgggcctcagtgaaggtctcctgcaaggcttctggtttcacctttaccagtctaataatatcggctgggtgcgacacggcccctggacaaggacttgagtgatggatggatcgagcgcttaacaatggtaacaactaaactatagtacagaaactcgaagggcagacgtcaccgatcgaaccanagaacacatccacgagacacacgcctacagtgagcgtaggaggacgccgtagagtatacgtgacgacgacggccgtagtacttacgtgtacggacggaagacggtacttacgacgtacggttcgggtccccggttacggaacccccggttcgggggacccgtacggggtaaccccgttcggggtacccg

SEQ ID NO: 317590 - DNA, 690 bp, Homo sapiens
  misc_feature: GZ8MTXP02H28P5.21.61.F06.1.454.CMB.2.raw
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctggagcgtgaggtgaagaagccgtgggcctcgagtgaaggtctctgctaaggcttcttggttctacctttaccagtctataatagtcggntgggtncgacgacggccctggacaaggcttgagtggagtgggagtggatcgaggcgtactttaacgaagttacggttaacaacaaaacgttatacggacctaacgaaacggtaaaacctcccggaagggtacccaaagggtacgtacccaaccgtatacggaaacccaacgaaacgaacaaccgactacccgaacgacacaaccacgtaccctaacagtacggacgacgtagggacggaacgacccgtaggaaccgtagtaccgtacggaaccggtaccgaccggttcgttagttactttacggaggttcggacgtaacgggacggtacttcggaacgtcgggtaacccgggtacccgggtttacccgaccccggggttcggggaacccggtaaacggggtcccccgtacgg

SEQ ID NO: 317591 - DNA, 644 bp, Homo sapiens
  misc_feature: GZ8MTXP02HJLWT.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttaccagtctataatatcggctgggtgcgacacggcccctggacaaggctgagtggatgggatggatcgagcgtacttacgaatggttaacaactaaatactcgacaacaagaaactccgaagggcagacgtaccacatacgaaccacagacaacactaccgaacgacgacaacacgaccctaagagtacgggagccgtaggaacgggtacgacccgtaggaaacgtacgttccgacggaacccggtaaaccgacccgggtaccggttaagtaacgtttaccgaggttccggaacggacggacgggtacgttaacggccgtaacgggtccgggttccccgggttacccggaccccggttggggacccccgtaacggggtaaccccgttccggg

SEQ ID NO: 317592 - DNA, 643 bp, Homo sapiens
  misc_feature: GZ8MTXP02I84AF.21.61.F06.1.454.CMB.2.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (480)..(480): a, c, t, g, unknown or other
  misc_feature (480)..(480): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctnagtgaaggtctcctgcaaggtcttctggtttcacctttaccagtctataatatcggctgggtncgacacggccctggaccaggtacttggagtggagtggggatggatcaggtcgtacttaacaagttggtaaccaactaaactntacgaccaacgaacgtaaacctccgaaggggcaaggacgtaccaaccagtaccgaaaccaacgacgaacctaccaactacccgaacggacacaaccaacgccctaacgagtgggacncgtacggaggacgtacccgtaggaagacgttaccgaggaacccggaacgaccgggtacgttacgttaacgttacgtggtcgacggtaggaacggtcttaacggcgtacggtccggggtcccggttaccggacccggtcgggacccgtaaccgggtaccgtcgg

SEQ ID NO: 317593 - DNA, 585 bp, Homo sapiens
  misc_feature: GZ8MTXP02I1ETG.21.61.F06.1.454.CMB.2.raw
  modified_base (187)..(187): a, c, t, g, unknown or other
  misc_feature (187)..(187): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtntccggagctgaggtgaagaagcctggggcctcagtgaaggtctcctgcaaggcttcgtggtttctaccttaccagtctataatatcggctgggtncgacacggcccctggacaaggacttggagtggatgggatggatcgagcgcttacaatggttaccaataaactatacgacacaacgaaactccgagggcagacgtcacatagaaccanagacacactacacganacacagacctacagtcggaagcgtaggacggacgccgtaggaagtactcgtagacggtacgaccggccgttagtacttacgtgttcggacggaggtacgtaccgtagcgtaggtccgggtcccggttccggaccccggtggggacccggaccggggttaacccgtccggg

SEQ ID NO: 317594 - DNA, 615 bp, Homo sapiens
  misc_feature: GZ8MTXP02JQVKP.21.61.F06.1.454.CMB.2.raw
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcgagtgaacggtctcctgacaggtcttcgttcggtttcctacctttacagtacttaatatacgtcggcgtgggtcgacgacgacggccccgtaggaaccaaggtctttaggaggtggagtgggatggatcgagcgtactaacgagtgtaacaactaaacgtcacgacacaacgacgcggagcagacacgacagacacanacacacacacganacacacacacanagagacncgaggagtacgcgtagactacgtcgacggaccgtacggaccggttacgtagttaacgttggtacggtaggacggtaggtaacggtacgtaccggtaccggtacgggtccccggtaccccggtaccgggaccccggggttacggaacccggtacccgggtacccggtcg

SEQ ID NO: 317595 - DNA, 675 bp, Homo sapiens
  misc_feature: GZ8MTXP02GDVQS.21.61.F06.1.454.CMB.2.raw
  modified_base (362)..(362): a, c, t, g, unknown or other
  misc_feature (362)..(362): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacgacggcccctaggacaaggtacttgagtggatggggatggatcgagcgtcttacaatggtaacaacaaactatgacaanaagaaactccgaagggcagacgtacaccatacgaccaacagacaacactacccaacgacgaccaacgacgaccctaacgacgtgggaaacgccgtagggaacggacgacccgtaggaacgtaacgttcgacggaaccggaacgaccgggtcccgttagttaacgtttaaccgtgggttacgaccgggtaaaggtacgggtacccgtttaaagggccgttaacggggttcccggggttaccccccgggttacccgggtaacccccgggttcgggggtaaccccgaaccggggggtaacccccgtttaccggggg

SEQ ID NO: 317596 - DNA, 687 bp, Homo sapiens
  misc_feature: GZ8MTXP02HEKPP.21.61.F06.1.454.CMB.2.raw
  modified_base (279)..(279): a, c, t, g, unknown or other
  misc_feature (279)..(279): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggcttctggttctacctttacagtctataatatcggctgggtncgacgacggcccctaggacaaggcttaggagtggagtggatggatcgagtcgtacttaagaagttcggtaacaacgtaaacttcgtacgaccaaacaaacgaaaccgtccggaacggggctaacgggtaactaccgaacctaagtaccgaaacccaaaccgaacaaccaacctacacccgaaacgacgaacctacccgaacgaccccgttaaacacggtacggaacgtacgtaacgggaacggtacgtaccgtagaacgtacgtacgacggaaccgacggtaccggtacgtacgttagttacgtggtacggacggtaagtacggtacgttacggccggttacgggtcccggtccccgggttaccggtaccccgggtaccggggtacccgtacccggggtacccgtcgg

SEQ ID NO: 317597 - DNA, 661 bp, Homo sapiens
  misc_feature: GZ8MTXP02FT32I.21.61.F06.1.454.CMB.2.raw
  modified_base (281)..(281): a, c, t, g, unknown or other
  misc_feature (281)..(281): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaaggaagccgtggggcctcaggtgaaggtctcctgcaaggcttctggtttccacctttaccagctataatatcgctgggtncgacacggcccctggacaaggacttgagtggagtgggatggatcgagcgacttacgaattggttaacaactaaactactgacaacaagaaacctccgaagggccagacgtacaccatcgaaccanacgacaacactacccaacgacgacaacctacgaccctaanacgtgggaacgccgtaggaaacgggacgtacccgtaagggaacgtacttcggacggaacggaacccgaccgggtaccgttagttaaacgtttaccgtgggtacgaccggaaggtacggtacgttaaccggcgtaaccgggtcccgggggttaccccgtttacccgggacccccgggttgggggacccccgaacgggggttaaccccctcccgggg

SEQ ID NO: 317598 - DNA, 741 bp, Homo sapiens
  misc_feature: GZ8MTXP02HTM7R.21.61.F06.1.454.CMB.2.raw
  modified_base (317)..(317): a, c, t, g, unknown or other
  misc_feature (317)..(317): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcgagtgaaggtctctgacaaggtcttcgtggtttctacctttaccagctaataatatcggctgggtgacgcgacggcccctggacaaggtcttgagtggangggatggatcgagcgtacttaacgaagtaggttaaaccaactaaaaacttgtacgaaccaacgaaacgaaaaccgtcccgaaggggaccaaggtaacgtcccaacccgatacgaaacccaacgaacgaaccaacactacccgaacgacgaccaacgtacacccctaagacgtaggggagaccgtagggaacgggtaacgtcccgttaggaaccgtagtaccggacggaaacccggaacgaacccggggtcgtttaacgttaacgtttacgtacggggttacggaaccggtaagggtaacggttaccgtttaacgggacccggttaacgggggttccccgggggtacccccggggtttaccccggaacccccccggggttgggggaccccccggtaaacgggggttaaccccccgtttccggggg

SEQ ID NO: 317599 - DNA, 656 bp, Homo sapiens
  misc_feature: GZ8MTXP02G3WBI.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaaggtcttctggtttcacctttaccagctataatatcggctgggtgcgacgacggcccctaggacaaggacttggagtggagtgggatggatcgagtcgtacttaacgaagttacggttaaacaactaaaacgtatacgaccaacaacgaaaacctccgaagggccagacgtaccaaccagtacgaaccacaacgaaccacaactacccaacgacgacctaaccacgaccctaacgacgtagggaacgccgtaggaacggtacgtccgtaggaaacgtacgttacgacggaaccgaccggtaccgggtaccgttagttacgtttacgtcggtacggacggaggtacggtacgttacggcgtacgggtccggtccccggttaccggaccccggtcggggacccgtacgggtaacccgttccgg

SEQ ID NO: 317600 - DNA, 661 bp, Homo sapiens
  misc_feature: GZ8MTXP02FLME5.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagtctataatatcggctgggtgcgacacggcccctaggacaaggacttgagtggatgggatggatcgagcgacttaacgaagttcggttaacaacgtaaactatagacacaagaaacctccgaagggcagacgtacaccatacgacccaacaacgaccaacactaccacgacgaccaacacgaccctaacacgtaggacgtccgtaggaaggacgtacccgtagggaagtaacgttcgacggaaccgaccgaccggggtacccttagttaaacgtttaccggtggttacggacgggaggtacggggtactttaacgggccgtacggggttccggggtacccccgggtttaccggaacccccggggttcgggggacccgaaccgggggtaaccccgtttccgggg

SEQ ID NO: 317601 - DNA, 728 bp, Homo sapiens
  misc_feature: GZ8MTXP02FM934.21.61.F06.1.454.CMB.2.raw
  modified_base (280)..(280): a, c, t, g, unknown or other
  misc_feature (280)..(280): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctcagtgaaggtctctgacaggtcttctggttctaccttaccagtctataatatcggcgtgggtcncgacgacggcccctaggacaacggtactggacgtgggatgggatcggatacggagcgtacgttaacagttacggtaacaaactaacgtagtacgtacgaacgtaacgaaaccgtccggtaagggcgaagtacggtcaacctagtacgaaccgaacaacgaccacgtacgtacccgaaggacgaccaacgacgtacctaacgtagtacgggactacggaggtaacggcgtaccgtagggtaatcggtactacgggaccgtaaccgacgggttaccgttagttaacttaccggttggtaaaccgtacggggtaaacggtacggggttaacgtttacgggtaccccggtaagggggtttccccggtaacccccgggggtttaccggtaacccccgggggttccgggggtaaaccccggtacccgggggtttaaccccggtttaacccgggg

SEQ ID NO: 317602 - DNA, 758 bp, Homo sapiens
  misc_feature: GZ8MTXP02IQG1P.21.61.F06.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcagcttctgttcaccttacagctataatatcggctggtgcgtacncggcccctggacaggacttggagnggagtgggatggatcgagacgtcttacgaaattggttaaccaaacgtaaactacgtcgaccaaacgaacgtaaaacctcccggaaggggccaaggaccgttacgaacccgtacgtacgaacccgaacaacgacaaccaactaccccaacgaacgaccgaccaacggtacccctaaagaagtcggaaacgtcgtaacgggaacgggaacgttccccgtaagggtaacgtacgtacggtacggaaaccgggaaccgtaccgggtacccggttagtaacgtttaccgtacggggtcgttaaacccggggaaggaaacgggtttccgttaaaacgggtcccgggtttaaacggggttaaccccgggggttccccccgggggttttaaccccggggaaaccccccggggttcccggggggacccggtaaaccccgggggtaaacccccgggtttacccgggg

SEQ ID NO: 317603 - DNA, 724 bp, Homo sapiens
  misc_feature: GZ8MTXP02JCKI5.21.61.F06.1.454.CMB.2.raw
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgtagtctggagctgaggtgaagaagcctggggcctcagtgaaggtctcctgcaaggcttctggttcacctttaccagtctataatatcggctgggtgcgacncggcccctggacaaggacttgagtggagtgggatggatcgagcgtcttacaagttcggttacactaaaactntacgaccaacgaacgaaaacctccgaggcgaggacgtacaacctagtaccgaaccaactacgaaccaactacgacccaacggacgccaacgaccggaccctaacgacgtagggaacgtaccgtagggaaacggacgacccgtaggtagggtaaccttaccggcggaaacccggaccggtaaaccggggttccccgttaaggtttaaacgtttaccggttaggttacgggtaccgggaggggtaacggtaccggttttacgggaccgggtaaggggttcccccggggtaacccggggtttacccccggtaccccgggggttacgggggacccggtaacccgggggtaccccgttacggggtttacccccg

SEQ ID NO: 317604 - DNA, 706 bp, Homo sapiens
  misc_feature: GZ8MTXP02I3CO3.21.61.F06.1.454.CMB.2.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgccccactcccaggttcagatgatgcagtctggagctgaggtgaagaagccgtgggcctnagtgaagtctcngcagcttctgttctacttacagtctatatatcggngtgggtgcgacgcggccctggacaggctggagtggagtggatggatcgagcgtacttaacgaagttacggttaacaaactaaacttatacgaccaacaaacgtaaacctacccggaaggggtaccaaggtaaccgtaccaacctagtaccggaacccaaacgaaaccgaccaaaccgactacccgaacgacgacccaaccgacgaccctaacgagtacggacggtacgtagggacgggtacgtaccgtaggaacgaaccgttcggaacggaaccggtaaccggacccgggttcgttaagtttaacgtttcggaggttacggacggtaaagggtacggtacgttaacggaccggttacggggtccccggggttaccccgggttacccggtaaccccggggtccgggggaaccccgtaccgggggttaccccgtttacccggg

SEQ ID NO: 317605 - DNA, 676 bp, Homo sapiens
  misc_feature: GZ8MTXP02H8APC.21.61.F06.1.454.CMB.2.raw
  modified_base (277)..(277): a, c, t, g, unknown or other
  misc_feature (277)..(277): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagctataatatcggctgggtncgacaggcccctggacaaggacttgagtggatgggatggatcgagcgcttaacgaattcggtaacaactaaaactntagacacaagaaacctcgagggcagagtccaaccatcgaaccacagacacactccgaacgacgacacacgaccctaacgacgtggaaacgcgtaggaacgggtaacgtcccgttaggacggtaacttccgtaacggaaccgaaacccggaccgggacccgtttaggttaactttaaccggtgggtttacggaccgggaaaggtaacgggttaccgttaaacggtccgtaacgggttcccgggggtaccccccgggtttaacccgggaccccccggttcggggggaacccccgtaaacgggggtaaacccccgtttcccggggg

SEQ ID NO: 317606 - DNA, 638 bp, Homo sapiens
  misc_feature: GZ8MTXP02GP06E.21.61.F06.1.454.CMB.2.raw
  modified_base (276)..(276): a, c, t, g, unknown or other
  misc_feature (276)..(276): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggttcacctttacagctataatatcggctgggtncgacacggcccctggacaaggctgagtggatgggatggatcgagcgacttacaatggttaacactaaactatgactaacaagaaactccgaaggggccaggacgtacaccagtacgacacagactacactccgaacgagaccaaccaggaccctaacgagtacggagtaccgtagggaacgggtacgacccgtagggaacgtacgttaccgaggaacccgaaccggaccgggtacccgttaggtacctttaacgtggttacggacgtaagggacggtcgttaacggcgtaacggggtccggtacccccggggttaccgacccccggtacgggggacccgtaccgggggtaaccccttcgggg

SEQ ID NO: 317607 - DNA, 617 bp, Homo sapiens
  misc_feature: GZ8MTXP02GSTRJ.21.61.F06.1.454.CMB.2.raw
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
  modified_base (516)..(516): a, c, t, g, unknown or other
  misc_feature (516)..(516): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcaaggtcttcgtggttcacctttacagctatatatcggctgggtgcgacacggcccctaggacaggtacttggagtggatgggatggatcagcgtcttaacaagttcggttaacaactaaactagtcgacaacgaagaaactccgaagggcagacgtacaccatcgaccanacgacacanccgaacgngaccacacgcctaanagtcggagccgtaggacggacgtaccgtaggaagacttcggacggaaccgagacccgggtccgttagtacgtttaaccggnggtacggacggtaggtacggtacgtacgaccggtacgggtcccggtaccccgggtaccggtacccccgggtagggggaccccggtacccgggtaccgtcgg

SEQ ID NO: 317608 - DNA, 700 bp, Homo sapiens
  misc_feature: GZ8MTXP02IOX1D.21.61.F06.1.454.CMB.2.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
  modified_base (450)..(450): a, c, t, g, unknown or other
  misc_feature (450)..(450): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcattccttttcttggtggcagcagcaacaggtgcccactcccaggttcagatgatgcagtctggagctgaggtgaagagccgtgggcctnagtgagtctctgcagtcttnttcgttcctaccttaccagtcttataatgtcggcgtgggtnccgacgaccggtcccctaggacgaaggcgtttgaggtggaagtggtagtaggtactcgacggccgtttacgtaacgtaagttacggtaaaccaaacgtaaaccttagacgactaaacgaaacgaaaccgtccggaagggtcgaaagtaccgtacaacccgtataccgaccaanaaccgtaacaccgtacacccgaacgacgaccaaccgacgtaccaacgtaggcgggaacgcggtacgggaaggtcgaccgttagggacacgttagacccgggacgtaaccggaccgggttaaccgttgttaaccgttacgtgggttacggacggtaggtaccgtacgttacggacggttacgggtcccgggttcccgggtaccgggaccccgggttaggggacccgtacccggggtaaccgtttcccgggg

SEQ ID NO: 317609 - DNA, 728 bp, Homo sapiens
  misc_feature: GZ8MTXP02IOG7W.21.61.F06.1.454.CMB.2.raw
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagagcctggggcctgagtgaggtctcctgcaggcttctgttcaccttacagtctataatatcggtgtgggtncgacacggcccctaggacaaggtacttggacggtggagtgggatggatcgagcgtacttaacgaagttcggttaacaacgtaaacgtacgtacgaactaacgaaacgaaccgttccgaaggggccaaaggtacgtaccaccgtaagaccgaaaccaacgaacgaacgaccacgtacccgaagaaccgactaacgacgaccctaagacgtacgggaacgtccgtaggaacggtacgaccgtagggaacgtacgtacgttacggaaacggaccggtaaccgggttccgttaaggttaaactttacgggtacggtttacgggaaacggttaacgggtacggttaccggtttaacggcccggttaacgggggttcccgggttaccccggggtttacccgggcccccgggggttaacgggggacccccgtaaaaccgggggtttccccttaacccggggg

SEQ ID NO: 317610 - DNA, 734 bp, Homo sapiens
  misc_feature: GZ8MTXP02G25JP.21.61.F06.1.454.CMB.2.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacaggtgcccactcccaggttcagatgatgcagtctgganctgaggtgaagacgccgtgggcctgagtgaaggtcctcgtgacaggtcttcgttcggtttccacctttaccgagtcttaataatcgtcggngtgggnccgacgcggccctggacaggtcttggagtggagtggatggatcgagcgtactagagtacgtaacaactaactctacgaccaacaacgtaacctaccggagggacctaaggactaccgaacctagacgaaaccacgaaactacaactcgaccagtacacacgactaccagacgtcgaagcgtaaaggacggacgtccgtaaggataccgttaccggaacggaccggtaaaccggtacccgggtttaccgttaaaggttaccgtttttaaccggggtacgggtacggtaaacggtacggggttaaccggttaacggttaacccgggtaccggggttaccggggttaacccccgggggtttaacccccggttaacccccgggggtaaccccggggttaccgggggtaaacccccgggtaaccccggggtttaccccggttacccggg

SEQ ID NO: 317611 - DNA, 613 bp, Homo sapiens
  misc_feature: GZ8MTXP02FRMAM.21.61.F06.1.454.CMB.2.raw
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagcctggggcctcagtgaaggtctcctgcaaggtcttcgtcggtttcacctttaccagtctaataatatcggctgggtncgacnggcccctggacaaggcttgagtggatggatggatcgagcgcttaacgatggtaacaactaaacgtatacgaccacgaagtaaaacctccgaagggccagacgtcaccgatacgaccacgaanacaaccataccgaacganacaacgacgtacctacagtacggacgtacgtagggaggacgcccgtaggacgtactacgacgacggacgacgggtacctggtaacttacgtaggttacggacgttaggacggtaccttaagcgtacggtaaccgggtcccgttaccggaccccggtcgggggaccgtaccgggaacccgttccggg

SEQ ID NO: 317612 - DNA, 603 bp, Homo sapiens
  misc_feature: GZ8MTXP02I8SOD.21.61.F06.1.454.CMB.2.raw
  modified_base (277)..(277): a, c, t, g, unknown or other
  misc_feature (277)..(277): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctatatatcggctgggtncgacaggcccctggacaggacttgagtggatgggatggatcagcgnttacatggtacanaaactntgcacagaactccagggcagagtcacatcgaaccanacgacacatccagacgcactacgcctaacagtaggacgcgttaggacgggacgtccgaggacgtaactcgtaggaacggtaccgaccgggtcccgttaggttaacttacgtgggtacgccggtaaggacggttccgtaaggcccgtaagggttcccgggtacccccgggtttacggaaccccccgggttggggacccgacccggggtaaccgggtttaaccccgg

SEQ ID NO: 317613 - DNA, 635 bp, Homo sapiens
  misc_feature: GZ8MTXP02IO9GR.21.61.F06.1.454.CMB.2.raw
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggtcttctggtttcacctttaccagtctataatagtcggctgggtgcgacgaggccccctaggaccaaggactttggaggtggatggggatggatcgagcgtacttaacaatggttaacaacgtaaactagtgacctacaaacgaaactccgaagggtcaagacgtaccaaccatacgaaccacacgacacactaccgacgaacgcacgacgaccctaacagtacggaagccgtagggaaacggcgtacccgtaggaagtacgtcgtacggaccgacgaccggtaccgtagtaacttacggtgtacgacggaggtacggtcgttaacgcgtaacggttccgggaccccggttccggaacccccgggtcggggtacccgaaccggggtaacccgttccggg

SEQ ID NO: 317614 - DNA, 622 bp, Homo sapiens
  misc_feature: GZ8MTXP02HVT8C.21.61.F06.1.454.CMB.2.raw
  modified_base (455)..(455): a, c, t, g, unknown or other
  misc_feature (455)..(455): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggggcctcagtgaaggtctcctgcaaggcttctggtttcacctttaccagctataatatcggctgggtgcgacaggcccctggacaaggcttggagtggatgggatggatcgagcgacttacaatggttaacacgtaaaactatagacacgaagaaacctccgaagggcagacgtacaccaatcgaccacaacgaacacactccacgacgacacgacgccctaacgatacggagccgtgaagggngcccgtaggagtacgtccgtaggaaccgacgaacccggtcgtacgttaacgtttacgttggtaggaccgtaggacggttaccttacgggaccgtagggtccggggtaccccgggtttaccgacccccgggtcgggggcccggaacgggggttaacccccgtccgggg

SEQ ID NO: 317615 - DNA, 640 bp, Homo sapiens
  misc_feature: GZ8MTXP02FR3KL.21.61.F06.1.454.CMB.2.raw
  modified_base (227)..(227): a, c, t, g, unknown or other
  misc_feature (227)..(227): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggctcagtgaaggtcncctgcaaggcttctggtttcacctttacagtctaataatatcggtctgggtgcgacacggcccctaggacaaggactgagtggatggatggatcgagcgattacagttgtacaacaatacgtnacaanagaaactccgaggcagacgtacaccatacgaccacagacacataccgaacgagaccaaccgaacgtaccctaaacgacgtacggggaacgtacggacggaacgggaccgtcccgttaagggacgaacgtaccgtacgaaccgaaccgtaccgggtacgttagttaacgttaccgtaggtacggtaccgaaggtacggttacgttaaacggcgtaaccggtaacgggtcccccggttaccgggaccccggttcgggggacccgtaaccggggttacccgttccggg

SEQ ID NO: 317616 - DNA, 657 bp, Homo sapiens
  misc_feature: GZ8MTXP02IW2JS.21.61.F06.1.454.CMB.2.raw
  modified_base (562)..(562): a, c, t, g, unknown or other
  misc_feature (562)..(562): n is a, c, g, or t
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctgggagctggaggtgaagaagccgtggggcctcagtgaaggtctcctgcgaaggtcttcgttggtttcctacctttaccagtctaataatacgtcggtcgtgggtcgcgacgaccggccccgtaggaacgaaggtacgttggaggtggagtgggagtggatcgagtcgtacttaacgaagtacgtaacaaactaaactactagaccaacaacgaaacgtcggaagggcaagacgtaccgaaccatacgaacccacaaacgacctaaacgacctaccgaagaacgaccaaccacgaccctaacgagtgggaacgccgtaggaacggacgccgtaggatacgtcacggaaccgacgtaccggtcgtagttaacttcgnggtaccgagtacggacgtacgtacgcggtacggtcccgggtaccccggtacccggtacccgggcgggtaacccgaccggggtacccgtacccggg

SEQ ID NO: 317617 - DNA, 682 bp, Homo sapiens
  misc_feature: GZ8MTXP02FM4GS.21.61.F06.1.454.CMB.2.raw
  modified_base (281)..(281): a, c, t, g, unknown or other
  misc_feature (281)..(281): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagagccgtggggcctcagtgaaggtctcctgacaggtcttcgtggtttcacctttacagtctaatatatcggctgggtncgacacggcccctaggacaaggacttggagtggagtggatggatcgagcgcttaacagtggtaacaactaaactatcgacacgacgtaaacctccggagggcaaggtacgtacaaccagtacgaacccacaacgtacaacactaccgaagacgccaactacgacctaacgagtacgggaagtcgtaaggacggtaaccgtccgtaggaacgtactaccggtacgaaccggtaaacgtcccgggactttacgggttaaacttcggtacggtacgggtacggaagggttaaccggtacgttaccgggacgttaccgggggttaaccgggtcccccgggtttaacccgggaaccccgggttccgggggaccccgggaaaaccgggtcccccggtttaaccgggg

SEQ ID NO: 317618 - DNA, 653 bp, Homo sapiens
  misc_feature: GZ8MTXP02J1QS5.21.61.F06.1.454.CMB.2.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctcgagtgaaggtctcctgcaaggtcttcgttcggtttcacctttaccagtctaatatatcggntgggtgcgacncggcccgtggaacgaaggtacttggagtggagtgggagtggatcgacgtcgtacttaagaagttacggttaaacaaactaaactacgtacgacaaacgtaacgaaaccgtaccgagggccaagaaccgtaccaaccgtagacgaaacccaacgtacgaaccacgtacacccgagacacgactaacgcctaacagtcggagcgtagggacggacgtcgtagagtctcgacgacgtaccgcggtacgttagttaactcggtggtcgacggagtacgggtactacgggaccgtagggtccccggtacccccggggttacccggaccccggtcgggggtaacccccgacggggtaccccgttccgg

SEQ ID NO: 317619 - DNA, 650 bp, Homo sapiens
  misc_feature: GZ8MTXP02HVHX8.21.61.F06.1.454.CMB.2.raw
tcagtcgtcgctcgcacgaccggtgctcgatttagctacgctctaagggaaagggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttcttggtttctacctttaccagcttaataatagtcggctgggtgcgacacggcccctggacaaggtacgtgaggtggagtgggatggatcgagcgtacttacaagtaggttaacaaactaaaactatacgacaacgaaacgaaacgtaccgaagggcaagacgtaccaccaatcgaaaccacaacgaacacgactacccgaaacgacgacctaacgacgtaaccctacgagtaggacgtaccgtaggacggacgaccgtaggacgagttccgaggaaccgaaccgaccggtccgtagttaacgttaccgtaggtcggacgtaggacggtacgtacgtccgacggtcccgggtaccccgggttacccggtaccccggtcggggaccccgtaaccggggttaaccccgtccggg

SEQ ID NO: 317620 - DNA, 635 bp, Homo sapiens
  misc_feature: GZ8MTXP02H8DC3.21.61.F06.1.454.CMB.2.raw
  modified_base (362)..(362): a, c, t, g, unknown or other
  misc_feature (362)..(362): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcgagtgaaggtctcctgacaaggtcttcgttggtttctacctttaccagtctaataatatcggctgggtgcgacacggcccctaggacaaggcttggagtggatggatggatcgagcgtacttacaagttgtaacaagtaaactntcgacaacaacgtaaaactccggaagggccaagggtactaccgaacctagtacgaaaccaacaacgacctaacgacacccgaacggacgaccaacgtacgaccctaacgagaggagtacgtagggaaggtacgcgagaagtacgttacgacggaccgaacgaccggtccgttagttacgtttacggtggtacggacgaggtacgtacgtacgacgtacgggtcccggtcccggtaccggacccgggtcgggacccggtaacggtacccgtcgg

SEQ ID NO: 317621 - DNA, 634 bp, Homo sapiens
  misc_feature: GZ8MTXP02HSWOK.21.61.F06.1.454.CMB.2.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaaggagcctggggcctnagtgaaggtctcctgcaaggcttctggtttcacctttacagtctataatatcggntgggtncgacncggcccctggacaggacttgagtggagtgggatggatcgagcgtacttacgaagttggttaacaactaaactntacggaccaacaacgaaactcccgaaggggtccaggacgtacaacctagtacgaaaccacaagaccaaccataccgacgacgacaacgacgaccctagacgtaggagtccgtaggaggtacgccgtaggacgagtccgagaacgaccgaccgggtcgtagttacgttacgtaggttacggacggtaggtacggtcgttaacggcggtagggtcccgggtacccggttacccggtacccggtaccggggtacccggaacggggtaaccccgttccgggg

SEQ ID NO: 317622 - DNA, 673 bp, Homo sapiens
  misc_feature: GZ8MTXP02FJR4Z.21.61.F06.1.454.CMB.2.raw
  modified_base (396)..(396): a, c, t, g, unknown or other
  misc_feature (396)..(396): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctgggggcctcagtgaaggtctcctgcaaggcttctggtttcacctttaccagtctataatatcggctgggtgcgacaggcccctggacaaggacttgagtggatgggatggatcgagcgcttacaatggtaacaacgtaaactatacgcaactacgaaaactccgaaggggcagacgtacaaccctanacgaacccaacagaacctaacaactacccgacgagaccaactacgacccaacagtaggaagcctaaggacgggacgccctaggagaacttacccgagaacccgaacgaccggggtacccgttaggttaaacgttaacgttgggacggaaccggtaagggaacggtaccgtttaaaagggccgtaaacgggttcccgggggtacccccgggtttacccgggaaacccccgggtcgggggtaaccccggaaaccgggggttaacccccgtaaccggggg

SEQ ID NO: 317623 - DNA, 647 bp, Homo sapiens
  misc_feature: GZ8MTXP02JTGD9.21.61.F06.1.454.CMB.2.raw
  modified_base (347)..(347): a, c, t, g, unknown or other
  misc_feature (347)..(347): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatcctttttcttggtggcagcagcaacaggtgcccactcccaggttcagatgatgcagtctggagctgaggtgaaggaagccgtgggggcctcagtgaaggtctccgtgcaaggtcttcgttggtttcacccttttacagtctaatatatcggctgggtgcgacacggcccctggacaaggtacttggagtggagtgggatggatcgagcgtacttaanaagtggtaacaacgaaactatcgacactaaacgaaactccgagggcaacggtcaccaccaatacgaacccacgaaacgaacaaccacacccgaacgacgacaacaccgacctacacgtcggagccgtaggacggcgcgttacggaaggctcgtaacggaccgacggtacccgacggttacgttaacgttacgtaggtacggcgtaaacggggtgaccgttaggaccttcggggtaaccgggttccccgggtacccggaccccgggtacggggtacccggaaaccgggttaacccggccgg

SEQ ID NO: 317624 - DNA, 650 bp, Homo sapiens
  misc_feature: GZ8MTXP02HUWK2.21.61.F06.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (452)..(452): a, c, t, g, unknown or other
  misc_feature (452)..(452): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagccgtgggcctnagtgaaggtctctgcagtcttctgttctacctttcagtctataatntcggctggtncgacacggcccctggaacaaggtcttggaggtggagtggatggatcgagtcgtacttaacaagtcgttaacaaaccgtaaatcgtacgacaacgtaacgtaaacctccggaagggaccaagtacgtaccaaaccgataccgaaaccctacgaacgtaaccaaccacacccgaacggaanactaaccacggtaccccaagacgtacgggaaactccgtaaagggaccggttacgacccgtaggacgtaactccggtaacggaaccgaccggaccggttaccgtagttaccgttaggcgtaggacgaggtacgtacgttacgcgtacggtcccggttcccgaaccggtccccggaggaccccggaacggtaccccgtcg

SEQ ID NO: 317625 - DNA, 615 bp, Homo sapiens
  misc_feature: GZ8MTXP02HZ1Q3.21.61.F06.1.454.CMB.2.raw
  modified_base (192)..(192): a, c, t, g, unknown or other
  misc_feature (192)..(192): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (418)..(418): a, c, t, g, unknown or other
  misc_feature (418)..(418): n is a, c, g, or t
  modified_base (512)..(512): a, c, t, g, unknown or other
  misc_feature (512)..(512): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctggagtgaagaagctggggcctcagtgaaggtctcctgcaggcttctggttcacctttacagctanaatatcggctgggtncgacnggccctggacaggcttgagtggagtggatggatcgagctcttaacatggttaaccaacgtaaactgtacgactaacagaaacctccgagggcagagtaccacatacgaccacacgacacacgaccaaggactacgaacncgaccgtacagtgaacgcggtaagaacgggtcgaccgtaggacgagttaccgagacccggaaacgtccggtaccgttagttacttacggttcgnggccgaaaggtacgggacctttaagggacttaacgggggtcccggtccccgggttaccgtaaccccgggtccgggggaaccgtaacgggggtaaccccgtcgg

SEQ ID NO: 317626 - DNA, 538 bp, Homo sapiens
  misc_feature: GZ8MTXP02FHSG9.21.61.F06.1.454.CMB.2.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
tcagtcgtcgctcgcacgaccggtgctcgatttagctacgctctaagggaaggggacccaaaaccacacccctccttggaagaatcccctagatcacagctcctcaccatggactggacctggagcatccttttcttggtggcagcagcaacaggtgcccactcccaggttcagatgatgcagtctgagctgaggtgaagaagcctggggcctcagtgaaggtctcctgcaaggcttctggtttccaccttttaccagctataatatcggctgggtgcgacacggcccctggacaaggacttgagtggatgggatggatcagcgcttacatggtacactaaactntgcanagaaacctccaggggcagacgtcaccatcgaccacagtaacacactaccacgagactacacgctacagtggancgngagacgctgagntcgagacgacaacggccgtagtacttaactggtgacgagacggacttacgcgtaggtcggcccggttcgaccccggtgggaccacggggtaaccctcggg

SEQ ID NO: 317627 - DNA, 662 bp, Homo sapiens
  misc_feature: GZ8MTXP02H6VEX.21.61.F06.1.454.CMB.2.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (439)..(439): a, c, t, g, unknown or other
  misc_feature (439)..(439): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctggaggtagaagagccgtggggcctnagtgaagtcnctgacaggcttcttggttcctacctttacagtcttataatatcggtntgggtncgacgacggcccctggaccaggtcttggagtggagtgggactaggntacgngcgtactttaanaagttagttaacaacgtaaactntacggaactaacgaaacgtaaaccctcggaacgggtcaaacgtacgttaccaccgaattcggaaacccaanacgaccactacgaccgaacgacgtacaccgaacgactacgagaggacgacggtaggacggtacgtaccgtagtacgacgtcggacgacggtaccgtacggtacgttacgtttacgttacgtggtacggacgtacggtaccgtacgtacggtacggtcgggtcccgggtccccggttaacccgggacccgggtaccgggacccggtaaccgggtacccgtacgg

SEQ ID NO: 317628 - DNA, 659 bp, Homo sapiens
  misc_feature: GZ8MTXP02GLRV0.21.61.F06.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagccgtgggcctnagtgaaggtctctgcagtcttntggtttcacctttacagtctaataatagtcggctgggtncgacgacgccctaggaccaggtacttggagtggngtaggatggatcgaagtcgtacttaacgaagttacggtaacaaacgtaaactactacgacaaacgtaaacgaaacctaccggagggaccaggtaacgtacccaaacctagaaccgaaacccaacgaacgaaccaacctacgacccgaaacggacgacctaaccacgacccgtaaanacgtaggaacncggtaagacggaacgtcgagtaacgtacgtacgaacggaccgtaacggaccggtaccgtttaagtaacgtttaccggtggtacgacggtaggtacgtaccgttagcgtacgggtccgggtacccggtcgacccggtagggacccgacggggtactccggg

SEQ ID NO: 317629 - DNA, 653 bp, Homo sapiens
  misc_feature: GZ8MTXP02G9WJ8.21.61.F06.1.454.CMB.2.raw
  modified_base (192)..(192): a, c, t, g, unknown or other
  misc_feature (192)..(192): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtagaagaagccgtggggcctcgagtgaaggtctcctgcaaggtcttcgtggtttacacctttaccagtctataatatcggcgtggtncgacncggccccgtggacaaggtacttgaggtggagtggatggatcgagccgtatagaagtggttaacaacgtaaactagtacgacctaacgaacgtaaaaccgtccgaagggccaaggtactaccgaaccagtacgaacccaacaacgaccactacaccacggacgactaacacgtaccaacacgtggacgtcgaggacggacgtacgagggatacgtccgtaacggaccgaaccggtaccggtaccgttagtaacgtttacgtccggtaggccgtaagggacgttacggtacgacggtacggtaacccgggcccggtttacccggaccccggttacggggaccccggaaccgggtacccgtaccgg

SEQ ID NO: 317630 - DNA, 710 bp, Homo sapiens
  misc_feature: GZ8MTXP02IH7X5.21.61.F06.1.454.CMB.2.raw
  modified_base (282)..(282): a, c, t, g, unknown or other
  misc_feature (282)..(282): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagcgtgaggtggaagaagccgtggggcctgagtgaaggtctcctgcgaggtcttcttcggtttctaccgtttacagtcttaataatgtcggngtggtgacgacgacggccccgtaggacaaggtactggagtggaagtgggagtggatcgacgtcgtacttaacgaacgttacggtaactaaacgtaaacttacgtacgacaaacgtaaacgaaaccgtccgaacgggactaaggaaccggtacaaccgtagtacgaaacccagaaaccgacaaccgaacacccgaacgacgtaaccacgaacgtaccctaagacgtacgggatcggtaaagcggaaccgcgtagaaccgtgtacgtaacgggaacccgtaaccggtaccgggttacgttacgttaccgttacgttaggcggaacgggtaacggttaacggttgtaacggtcgtaccgggtaacccgggttcccgggtccccgggtacccgggtaccgggacccggtaaacccgggtaccgtttacccgg

SEQ ID NO: 317631 - DNA, 574 bp, Homo sapiens
  misc_feature: GZ8MTXP02FUDP3.21.61.F06.1.454.CMB.2.raw
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (555)..(555): a, c, t, g, unknown or other
  misc_feature (555)..(555): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgcaggcttctgtttcacctttacagtctataatatcggntgggtncgacgacggcccctaggacaaggacttgagtggatgggatggatcgagcgtacttaacgagttacggttaacaactaaaactntacgaccaaacgtaacgaaaacctccggaagggccaaggtactaccaaacccgtanacgaaccaacagaaccaacacgtcccaagacgacaacacacctanagtcgagacaggaggacncaggatcgacgnaacggacgacgacgtgtaactcgtgtagcggagacgtctagcgtagtccggtccgtccgaccgngggtaccgacggaccgtcg

SEQ ID NO: 317632 - DNA, 647 bp, Homo sapiens
  misc_feature: GZ8MTXP02ISIHX.21.61.F06.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (291)..(291): a, c, t, g, unknown or other
  misc_feature (291)..(291): n is a, c, g, or t
  modified_base (476)..(476): a, c, t, g, unknown or other
  misc_feature (476)..(476): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagccgtgggcctnaggtgaaggtctccgtgacgaaggtcttcgtggtttacctacctttaccgagtctaataatagtcggctgggtncgacacggcccctggaacaaggtacttggagtggagtcgggatggactgagtcgtcttaacgattaggtaaccaagtaaactgtacgactaacaaacggtaaactccggaagggcctaaggtacaccaaaccctagtaccgaaaccaacgaacgtaaccacactaccgaaacggcaacaccgtanaccctagacgtgggaactacgagggaaggtaccgtacctagggaactacgtacgtacgaaccggacgtaccggtaccgtagttactaccggttgcggacgtaaaggtcgtaccgtagcgtaggtccggccccggttaacgcccgggtaggacccgtaacggacccgttcgg

SEQ ID NO: 317633 - DNA, 632 bp, Homo sapiens
  misc_feature: GZ8MTXP02FF9TG.21.61.F06.1.454.CMB.2.raw
  modified_base (351)..(351): a, c, t, g, unknown or other
  misc_feature (351)..(351): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttacagtctataatatcggctgggtgcgacacggcccctggacaaggacttgagtggatgggatggatcgagcgcttacaaagtggtacacgaaaactntacgacaacaacgaaactccgaggggccaagacgtacaccatcgaaccaacacgaacaacctaagacccaacgacgacaacacgacccttagaatcgggaacgctaggacggacgcctaggaacgatcgtacgaacgacgaaccggccgttaggttacttaaccgtggttacggccgaaagggtacggtacgttacggacgtaacgggttccggggtaccccgggtttacccggaacccccgggtcgggggtacccgaaaccgggggacccttaccggggg

SEQ ID NO: 317634 - DNA, 572 bp, Homo sapiens
  misc_feature: GZ8MTXP02FUDHS.21.61.F06.1.454.CMB.2.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtggggcctnagtgaaggtctcctgcaaggtcttctggtttcacctttaccagtctaataatagtcggcgtgggtncgacgacggcccctaggaacaaggtacttggagtggagtgggatggatcgagcgacttaanaagttgtaacaaactaaactatacgacaacgaagaaacctccgaagggcagacgtacaccatacgaaccaacagacacanaccacgagacacancctaanagngangagagncgtagagtacngacgacgacgcggtactagtactagnggagacgaaggacgtacgtacgcgtacggtcccggtcccggtaccggacccggtcgggaccgtacgggtaccgtcgg

SEQ ID NO: 317635 - DNA, 663 bp, Homo sapiens
  misc_feature: GZ8MTXP02IO2FB.21.61.F06.1.454.CMB.2.raw
  modified_base (288)..(288): a, c, t, g, unknown or other
  misc_feature (288)..(288): n is a, c, g, or t
  modified_base (558)..(558): a, c, t, g, unknown or other
  misc_feature (558)..(558): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagagccgtggggcctcagtgaaggtctccgtgacaggtctttctggtttcctacctttaccagtctaataatagtcggacgtgggtncgacacggcccctaggacaggtacttggagtggagtggatggatcgagctacttaacagttgttaacaactaaacttgtacgacaacaacgaacctccgagggtacacgggtactaccgaacctagtacgaaaccacgaacgaacctaacacaccgaaacgacgaccaaccacgacccttaacaggaggacgacgaaggacggacgccgtagaacgtaacgttccgaggaaccggtaccgaccggggtaccgttaagtaccttttacggnggtacggacgggtaaggtacggtacgttaacggccggttaccgggtcccgggttccccggttaccggaccccggggtacgggacccggtaccgggtacccgtcgg

SEQ ID NO: 317636 - DNA, 704 bp, Homo sapiens
  misc_feature: GZ8MTXP02G8U6D.21.61.F06.1.454.CMB.2.raw
  modified_base (275)..(275): a, c, t, g, unknown or other
  misc_feature (275)..(275): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctggaggtgaagaagccgtgggcctcagtgaaggtctcctgcaggtcttctggtttctacctttacagtctataatagtcggngtgggtgcgacgacggccccgtaggacgaaggcttgagtggagtgggatggatcgagtccgtacttaacgaagttacgttaacaaacgtaaaactactacgaaccaacgaaacgtaaaccgtaccgaagggacgaacgacgtaccaccgtanacgaaccacaacgacaactacaccgaacgacgacacgacgtacctaacagacggataccgaggaacggacgtcccgtagggaacttacgtaaccgtacggaaaccgaccggtaaccgggtacggttaacgttaacgtttacgacggggttagaccggggttaaggaccggtttacgttaaacggcccgggaacggttccccggggaccccggtttaacccggggcccccgggttaggggaacccccggtaaccgggggtaaaccccgtttcccgggg

SEQ ID NO: 317637 - DNA, 665 bp, Homo sapiens
  misc_feature: GZ8MTXP02HYHLW.21.61.F06.1.454.CMB.2.raw
  modified_base (194)..(194): a, c, t, g, unknown or other
  misc_feature (194)..(194): n is a, c, g, or t
  modified_base (269)..(269): a, c, t, g, unknown or other
  misc_feature (269)..(269): n is a, c, g, or t
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (449)..(449): a, c, t, g, unknown or other
  misc_feature (449)..(449): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcattccttttcttggtggcagcagcaacgaggtgcccactcccaggttcagatgatgcagtctggantgaggtgaagagccgtgggcctgagtgaggtctctgacgagtcttcgtgttctaccttacagtctatatagtcgngtgggcgcgacgcgcccgtaggacaggtacttgagtggagtgggagtgganagtgacgtgtactagtagtacaactaaagtcgtacgactaanaacgtaaccncggaagggcaaggtactccaaccagtaccgaaccagaacacaactcaacccacgacaccgtacgactaacccgtaanacgtacggacgacgaacgggacgtacggtaccggagacgtacgtaccgtaacggacccggtacggtaaccggtccgttaagggttactttaccgggaggtacggaacggtacgggtacggtacggtaccggtaccggtaaccggggtcccgggtaccccgggttacccgggtacccggggtaccgggtaccccggtacggggttacccgtaccggg

SEQ ID NO: 317638 - DNA, 637 bp, Homo sapiens
  misc_feature: GZ8MTXP02F8Y0I.21.61.F06.1.454.CMB.2.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcaggtgaaggtctccgtgacaggtcttcgtggtttccacctttaccagtctataatgtcgctgggncgacncggccctaggacaaggcttgagtggagtggatggatcgagcgtactagaatgtaacaactaatctgacaacaagtaaacctccgagggcagacgtacaaccgatacgaaccgataacgaccaacgtacaccgaacgacgacaccgacgaccctaacgagtacggacgtcgtaagggacggtacgaccctaagggaacgtacgttacgtaccggaaccggacgaccggtccgttagttaaccttaggtcgtaggtaccgaaggtacgtacgtacggcgtaacggggttcccggtaccccggttacggacccccggttaggggacccgtaaccggggtacccttcccgggg

SEQ ID NO: 317639 - DNA, 631 bp, Homo sapiens
  misc_feature: GZ8MTXP02G00KA.21.61.F06.1.454.CMB.2.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtgggcctcagtgaaggtctcctgcaggcttctggtttccacctttaccagctataatagtcggcgttgggtcgcgaccgacggcccctaggacaaggtcgttagaggtggatgggatggatcgagcgacttacagtagtacactaaatacncganaacacgaacctacgaggcagagtcacatacgacacagacacaactcaacgacacactacgacctaanacgtgaacgtcgaggacggngtaccgagacgttacnccgtacggacgtacggacggtacgtagttaagttacgtaggttacggacggtaacggtaggttaccgttaacggcggttaaccgggtccgggttaaccccggggtttacccgggaccccggtacgggggtacccggtaaccggggtaccccggtttaacccggg

SEQ ID NO: 317640 - DNA, 705 bp, Homo sapiens
  misc_feature: GZ8MTXP02ISFAD.21.61.F06.1.454.CMB.2.raw
  modified_base (192)..(192): a, c, t, g, unknown or other
  misc_feature (192)..(192): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagaagcctgggcctcagtgaaggtctcctgcaaggtcttctggtttcacgtttaccagctaatatatcggctgggtncgacncggcccctggaacaaggcttgagtggagtgggaatgggatcgaagcgtacttaacaagtaggttaacaacgtaaaccgttancgtaaccagtaaacggaaacttcccgaaggggtccaacggaactaccgaacccagttaccggaaaccaacaacgaacccttaaacaccttaaccgaccggaagacctaacgacgtacccgtaaaccagttacggaccgtagtacggacggttaaacgccgtaggtaaccgaaagtttcccgaggaacccgaacgtacccgggtaccgtttagggtaacttttaaacggcgttcggaaaccggagtaacgggggtaaccctttgacgtaacggtccggggtaccccggttacggacccccggttcggggaaccccgaacggggtaaaaccccccgttcggg

SEQ ID NO: 317641 - DNA, 734 bp, Homo sapiens
  misc_feature: GZ8MTXP02GP46Z.21.61.F06.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctgganctgaggtgaagagccgtggggcctnaggtgaaggtctcctgcaaggtcttcgtggtttcacctttacagtctaataatatcggctgggtgcgacgcggccccgtaggaactaaggactaggaggtggagtagggatggatcgagaccgtacttaacaaagttcggttaaacaaacgtaaaactacgtacgaccaacgtaaacgaaacgtacccggaagggaccaaacgggtaacttacccgaaaccctaacgtaccggaaacccaaacaccgaaacctacccaacgacccgaaacgacgacccaaccgaaccgtacccgaagaagtgggacgtaccgagggaacggtacgccgtaaggacgtaaacgtcgaaccggaacgtaccgaccggtaccgttagtacgttacgtcgggtacgacgggtaaacgtacggtacgttacggaccggttaaacggggtcccggggttacccccggttaccccggtaaccccgggggccggttaaacccggggaaccccgggtttaaacccggttcccgggg

SEQ ID NO: 317642 - DNA, 648 bp, Homo sapiens
  misc_feature: GZ8MTXP02I40Q2.21.61.F06.1.454.CMB.2.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttntggttcnctttacagctataatatcggctgggtncgcaggcccctggacaaggctgagtggatgggatggactcgagcgtacttactaagtaggttaaccaacgtaaactatcgactaacagtaaaactccgaagggtccaaggtacgtacacccgatacgaccacagaaccacactacccgaagaacgtaccacaacgccctaacacgtggacgacgtaggacggaagccgtagacgtaatcgtacggacgtaaacgccgggtacgttacggttacttaaccgtgggtaggaaccgtaggggtaacggtctttaaacgggccgtaaacggggttccgggtaccccggggttacccggaaccccggggttcgggggaccccggaacggggtaccccgtttaccgggg

SEQ ID NO: 317643 - DNA, 679 bp, Homo sapiens
  misc_feature: GZ8MTXP02FL5P1.21.61.F06.1.454.CMB.2.raw
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
tcagtcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagccgtggggcctcagtgaaggtctcctgacaaggtcttctggtttcacctttacagtctaataatatcggcgttgggtgcgacgtacggaccccgtggtaaccgaaggtacttggagtagggtagtagggataggatcgagcgtacttacgaattacggtaacaaactaaactactagaccaacgtaagaaacctacccggagggtcgaaacgtacgtacaaccgaanacgaaacccanaacgaacacaaccgaccaacgaacgacgaccacgacctaanacgtaggagcgtaggacgacgccttagagaccgtagacgacgaccgacgggtaccgttagtacgtttacgtaggtacgagggtaacgtacgggttacttacggaacggtaccggttccggggacccccgggttacggttaacccccggggccgggggtaaacccggtaaccgggggttacccgttacccccggg

SEQ ID NO: 317644 - DNA, 557 bp, Homo sapiens
  misc_feature: GZ8MTXP02HGVB3.21.61.F06.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagtcgtcgctcgcacgaccggtgctcgatttagctacgctctaagggaaaggggacccaaaaccacacccctccttggaagaatcccctagatcacagctcctcaccatggactggacctggagcatccttttcttggtggcagcagcaacaggtgcccactcccaggttcagatgatgcagtctgganctgagtgaagaagcctggggcctnagtcgaaggtctcctgcaaggcttcttggtttcacctttacagtctataactatcggntgggtncgacaggcccctggacaaggtccttgacgtggatggtatggntcgaagcgctanagtaggtacanaaactngcanagaanccgagcaagacgcacagtcgaccacagaccacgataccgaacngactacgagtacccagangagacctagnggaacgtcagagactgtagaacgacgacggtacgtagtaacgttctacggtgaccgtgaacgggtcttaaaggcgtacgtaacggtcccggttcgaccccgtaggggtccaacggggtacctccggg

SEQ ID NO: 317645 - DNA, 506 bp, Homo sapiens
  misc_feature: GZ8MTXP01D0MDV.38.13.B02.1.454.CMB.2.raw
  modified_base (296)..(296): a, c, t, g, unknown or other
  misc_feature (296)..(296): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttatactatgtctactggtaccaacaacaccaggcaaacgccccaaatcatgatttangagtcactaatcgccctgagggtttctaatcgcttcctctggctccaagtctggcaacacggcctcctgaccatctctggctccgagctgaggacgagctgattatactgcagctattanagaagagtagacactgtggtgttcggnggaaggacaagcgtagaccgttcgttagttcaacgccaaggctcgcccctcggttcctaaccg

SEQ ID NO: 317646 - DNA, 632 bp, Homo sapiens
  misc_feature: GZ8MTXP01EKEH3.38.13.B02.1.454.CMB.2.raw
  modified_base (224)..(224): a, c, t, g, unknown or other
  misc_feature (224)..(224): n is a, c, g, or t
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatcctcctgcactggaaccngcagtgacgttggtagttataactatgtctactggaccaacaaccacccaggaccaaacgcccccaaactcaatgtatttatgagtacactaatccgacctcgtagggtttctaatcgtcttcctctgctcagtcngcaacacgccctcctcgacatctacgtggcctcgagctggacggacgtagctagttacttattacgngtacgtacgtcgtttaacttaagttaaagaaaggtaagtacgtactaaccgtttacggttacggttacgggtttaccgggaacggggtaaacgggaaccgtaaacggttcgttaccggtaaccccggttacgttaaacggttaccaacccggacccgtaacgggcccgttccccggacccccgttccgggttcccttaaccccgg

SEQ ID NO: 317647 - DNA, 583 bp, Homo sapiens
  misc_feature: GZ8MTXP01D9EQY.38.13.B02.1.454.CMB.2.raw
  modified_base (417)..(417): a, c, t, g, unknown or other
  misc_feature (417)..(417): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctactggtaaccaacaaccacccaaggaccaaacgacccccaaactcaatgtatttatgaggtacactaatccggccctgtagggtttctaatcgtcttcctctggctccaagtctgcaacacggcctccctgaccatctcgtggctcgagctaggacggacgnggctgtattattactgctagtccttattaagtaagaaagtaagtacgactacgttcgtgggttgttccgggaacgggtaacgggacctaaagccgtacggaacccgttaccgttaagttccgaacgacccgtaaggcccgtaccgcccccgtcggttcctaacccg

SEQ ID NO: 317648 - DNA, 576 bp, Homo sapiens
  misc_feature: GZ8MTXP01DPYV9.38.13.B02.1.454.CMB.2.raw
  modified_base (223)..(223): a, c, t, g, unknown or other
  misc_feature (223)..(223): n is a, c, g, or t
  modified_base (296)..(296): a, c, t, g, unknown or other
  misc_feature (296)..(296): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcactggaaccngcagtgacgttggtgttatactatgtctactgtacaacaacaccaggcaaacgcccccaaactcatgatttangagtcactaatcgccctcgagggtttctaatcgtcttctctgctccaagtctgcacaccgcctcctgacatctctgggctcgagctgaggacgaggctagattattactgaccagtcttacttaataaggaagtaagtacgactacgttcgtgggtcgtttcggggaacgggtaacgggacccgtaaagccgtacggtaacccgttacccgttaacggttacccgaacggtccccgaaacgggtcccctccggcccccgttcgggttccctttaaccccg

SEQ ID NO: 317649 - DNA, 709 bp, Homo sapiens
  misc_feature: GZ8MTXP01DQ9XX.38.13.B02.1.454.CMB.2.raw
  modified_base (228)..(228): a, c, t, g, unknown or other
  misc_feature (228)..(228): n is a, c, g, or t
  modified_base (362)..(362): a, c, t, g, unknown or other
  misc_feature (362)..(362): n is a, c, g, or t
  modified_base (588)..(588): a, c, t, g, unknown or other
  misc_feature (588)..(588): n is a, c, g, or t
tcagtcgatcacgtcacgaccggtgctcgatttagtctagcgactttaggtttggggatcacataacaaccacattcctcctctaaagaagcccctgggagcacagctcatcaccatggactggacctggaggttcctctttgtggtggcagcagctacaggtgtccagtcccaggtgctagttggtgcagtcgtggggctggaggtgaagaagcgtgggtcctgggngaacggtcccctgcgagtcgttcgtggagcctaccttcagcacttatacttcagtcgtgggtcgcgacgacggccccgtggaacgagggtcttaggagtcggggaagtggggacgggtactcccgttacccgtnttacgttacggacaaaccacctaacccgtaccgacacgaaccgtaacgttacccaaggcctaaacgaccgttacccgaacggtacgtacccggacgggaaactacgaccaaacggacgacctaacgtacttaacccgataagtcggaaagagaggtaagtaccgcggtaagtacgacgttacgacggaaccgaccgtaacgggttccgttgtttaaccgtttcggnggtacgggaacgggtaggggaccgggcggggttaccgggtggggttacggttacggggttagggttaacggttggtaggttaacgtttaggacggttacggtaacgggttaagggtaaccg

SEQ ID NO: 317650 - DNA, 611 bp, Homo sapiens
  misc_feature: GZ8MTXP02HRXH0.38.13.B02.1.454.CMB.2.raw
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
tcagtcgatcacgtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctactggtaccaaacaacacccaggacaaacgcccccaaaatcatgatttangagtcactaatcgcctntagggtttctaatcgtcttcctctcgctaccaagttctggccaaacgaccggcctccctagaccctatctcgtggcctcgaggctgaggacgnggctgtattatactgcagtccttattagtaagaaagtaaagtacgactacgttcgtgggttcggttccggggacgggaacgggggaacccaaagggtccgttaaccggacccggttacccttaaaacggggttccaaacggtccccccgaaaaggggtcccctaccggtacccccccccgtagggtttccctaaccccg

SEQ ID NO: 317651 - DNA, 520 bp, Homo sapiens
  misc_feature: GZ8MTXP02HH2QC.38.13.B02.1.454.CMB.2.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctactggtaccaacaacacccaggacaaacgcccccaaatcatgatttangagtcactaatcgcctcagggtttctaatcgcttcctctgctcaagtctggcaacacgcctcccngaccatctctggctcagctgagacgagctgattatacngcagtctnttatagaagaagtagactactcgtggtcgttcggacgggacggacgaacgcgtacgaccgtaccgtaagtcaacgccgaaacggtcgtaccgccccgtcggtctaccg

SEQ ID NO: 317652 - DNA, 509 bp, Homo sapiens
  misc_feature: GZ8MTXP02F7X22.38.13.B02.1.454.CMB.2.raw
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctactggtaccaacaacacccaggcaaacgcccccaaatcatgatttangagtcactaatcgccctgagggtttcaatcgcttcctctggctccaagtctggcaacacggcctccctgaccatctcgtgggcctccgaggctgaggacgaggctgattattaacngcagtctacttatagaagtagtagcactctggtgttcggacggaggacagctagacctcgtaatcaacgccaaggctcgcccctcggctaccg

SEQ ID NO: 317653 - DNA, 612 bp, Homo sapiens
  misc_feature: GZ8MTXP02GDG4Z.38.13.B02.1.454.CMB.2.raw
  modified_base (223)..(223): a, c, t, g, unknown or other
  misc_feature (223)..(223): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccngcagtgactagttggtcattataactctgtctcgtggtaccaacaacacccaggccaacgcccccaaactcattattatgaggtccggaatcggccctcaggaactttctaatcgtcttcnctgctcagtctgacacncgcctcctgaccatctctcggactcccgtaggcctggacggtacgaggcctaggtaatttacctaacgtgaccctaaggtttaccaagttacgttaacaaacgtaccaaccttaacccgttacccttcgttttacccttaggttttaaccgttccgggggaacgggtaacggggtacccgtaacggggtcggtaaccccgtaaccgtaacggttaccgacggaccccaaggggtccctaccggtccccccg

SEQ ID NO: 317654 - DNA, 688 bp, Homo sapiens
  misc_feature: GZ8MTXP02H0SXH.38.13.B02.1.454.CMB.2.raw
  modified_base (251)..(251): a, c, t, g, unknown or other
  misc_feature (251)..(251): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcatcaccatcctcctgcacgtggaaccagcagtgtacgttggtagttataactntgtctacgtcggtaaccaacacgccgacccggacaactaccgaaccccccaaaaatcctaattagtaattttaagtaggtacggttacctaaccttactaacgttcccggtacccctacggtaacgggttactttactaaccttcgttccttctcgtcaccttactccgtaagtcgtacgacctaaccgcccgtccctccgtacacctcgtcgtcggtcggaccctcgacgtcgtagggaacggtacgtacgttaactttatttacgtttacgtacgtacttaagtactaattaaacctaacccaacgaactaacctaacctaccttcgtaacgtacgtttaacgggtaccggggaaacgggaaaccggtacgtaacgtccgtaaccgtaaccgtaacgtaacgtaccgaccgtaaaccgtcggtacccgtccccgg

SEQ ID NO: 317655 - DNA, 610 bp, Homo sapiens
  misc_feature: GZ8MTXP02GO3WO.38.13.B02.1.454.CMB.2.raw
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagtcgatcacgtcacgaccggtgctcgatttagtctagcgactttgggtttgaggatggttttctcgatgggggctgggagggctttgttggagaccttgcacttgtactccttgccattcagccagtcctggtgcaggacggtgaggacgctgaccacacggtacgtgctgttgtactgctcctccgatctttggcaaaccacactacgcacacaagttccaggacagactcacgattaccgcgacgaatccacgagcacagtctacatgganatgagtagcctgagatcngacgacacggccgttntatttctgtgacgaggaggacgggggccgaggggtctacggggtaggtaaggttaggtgttctttagattcgtcgtagggggaccgaaagggactaagtcggtactacccgtctccctcacgccctacccgaaccgaccggccctacgttcccggtccctccccgtacggcccctaccccgtcctaccgaaacggccgaccacccgtgggtcgggacaacgcggccggccgtgggcctcggccgtcggacgacggtacctacgtaccgacgtgacgtcgacgtgacggtcgggactcggg

SEQ ID NO: 317656 - DNA, 615 bp, Homo sapiens
  misc_feature: GZ8MTXP02JYFVM.38.13.B02.1.454.CMB.2.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtcctgggtctcctggacagtcgatcacntctctgcactggaaccagcagtgacgttggtagttatactatgtntactgtaccaacaacacccaggacaaacgaccccaaatcgatgtatttagngagtacactaagcgtcccgtgtacgggtttactaagtcgtacttcccgtctggcctcgaacgtcgtggacctaaccgaaccggtcccttacccgcgtaacctacttccgttcccgcggggtaccctcccgaagggtcgtaggacgggtaccggaggtacgtagttagtttaacttaacgtggctacggtctacgtaagtaagaaagtaagtacgactacgtcgtggtgtacggcgggtacggacgaacgcgtaccgacgtaccgttaacgaccgaacgacccgaacggtcctcccggacccctcggtaccctcg

SEQ ID NO: 317657 - DNA, 513 bp, Homo sapiens
  misc_feature: GZ8MTXP01CIQ70.10.79.H02.1.454.CMB.2.raw
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccacgctctcctgcagggccagtcagagtcttagcagcaactacgttgcctggtaccaacagaaacctggccaggctcccgggctcctcatctatggtacatctagcagggccatggcatcccagacaggttcagtcggcaggtgggtctggggaacagcttcacttctcaccatcagcagactggagtctgaagtatttgctagtgtattattgtcagtcaatagtggtagtcacgtgggtactttggccgtaggggaccaagcgttggagagtacgaacgacgttgttggctgcacattctgttcttc

SEQ ID NO: 317658 - DNA, 669 bp, Homo sapiens
  misc_feature: GZ8MTXP01DU3SP.10.79.H02.1.454.CMB.2.raw
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctggtggagtcgtgggggagcttggtcaagcctggaggtccctgagactctcctgtgcagcctntggacttcgcctcgtggattgacgttcagtgactactacatcgaccgtgggtcccnccgaggcctaccggaagggggaggggctaggggagttggggtttaccattactattttacnccgttaaggtggtgaacttaacccattaactacctacggcaagtactcgtaggtaggaacggggcctattaccaacctactcctaccgacgggaaccaaaccgaccaaagggtaacccttcgaacttacgtaactttacgaactaaattacgaaaccctacccgtaggaccggaacggaacccggaaggacccgtaaccggttacccgtaattacgttacgttggttacgtaacgaaacgtaaccttaaccccggttcgttaccgttcggtttaactttaaccg

SEQ ID NO: 317659 - DNA, 645 bp, Homo sapiens
  misc_feature: GZ8MTXP01DQ81D.10.79.H02.1.454.CMB.2.raw
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctggagggtccctgagactctcctgtgcagcctctggattcgcctctggattgacgttcagtgactactacatgacctgggtccncaggctcgagggagggctggagtggtttcatacatttancctaagtgtgataccatactactacgcagactcgtgtaggaacgggtccgtaattccaacctactcccgtaccgaaggggaaccaaaccgaccccaaagggtaaccctacctaacttacggtaacctttgaacctaaaagtacgaaaccctaccccgtagacccggaacggcccggaacgggaaccgaccgggttacccgttaattaacgtttacgttggttacggaaccgtaaagtaaaccgttaaccccggttcgttacccgttaagggtttaactttaacccg

SEQ ID NO: 317660 - DNA, 554 bp, Homo sapiens
  misc_feature: GZ8MTXP01BGQ2G.10.79.H02.1.454.CMB.2.raw
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (485)..(485): a, c, t, g, unknown or other
  misc_feature (485)..(485): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctcgtggattgacgttcaggtnactactacatgaccctgggtcccncaggctccgaggggaggggctggagtggttcatactatttancctaagtggtnataccatactactacgcagactcgtggtaggaaggccgtattaccattcacttcaccgagggacaacgaccaaagactcactgtacttgacaaatcgacaccctgccgngccgaggaccgacgccgtaattgttcttggtcgcgaacgaacttacccgttacggtccttggtttaacc

SEQ ID NO: 317661 - DNA, 527 bp, Homo sapiens
  misc_feature: GZ8MTXP01CFIJM.10.79.H02.1.454.CMB.2.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatcccagacaggttcagtcggcagtgggtctggggaacagcttcactctcaccatcagcagactggagtctagaagtattttgctagttgtaattattgtcagtctaatagtggtagtcacgttgggtactttgggcctaggggaccaaggcttgggagagtacgaaacgttacgttggttaggctgcaccgtattctgttcttaac

SEQ ID NO: 317662 - DNA, 640 bp, Homo sapiens
  misc_feature: GZ8MTXP01BPLW4.10.79.H02.1.454.CMB.2.raw
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggcctgggagggtccctgagactctcctgtgcagcctctggattcgcctcgtggattgacgtttcagtgactactacatgaccgtgggtcccncaggctccgaggggagggctggagttgggttccagtactatttatccgtaagtcggtgactaccatatactacgnagactctggtgaacgggccattcacatccacgagggacaacgccaaaggactcgactcgtaacttgactaaagtcgaaacctcccgtaggccgaacggcccgggaacggaaccgtaacccgggggttacccgttaaagttacgtttaaaccgttgggttacgggaacccggtaaacggtaaaccgtttaaacccccgggttcggacccgttttaacggggttttaaccctttaacccgg

SEQ ID NO: 317663 - DNA, 541 bp, Homo sapiens
  misc_feature: GZ8MTXP01AVDD3.10.79.H02.1.454.CMB.2.raw
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagccgtggagggtccctgagactctcctgtgcagcctctggattcgcctctggatgacgttcagtgactactacatgacctgggtccnccaggctccgaggggagggctgggagtggtttcatactattnctaagtggtnataccatatactacgcagactctgtgagggccattcacatcncgagacacgcaagactcactgacttgacaaatcgaacctaccctgccgagccgaggacaccggcgtatacgttacttggttcgaacgacgtaaacttaccccggttcgacttcggttaactttaacccg

SEQ ID NO: 317664 - DNA, 612 bp, Homo sapiens
  misc_feature: GZ8MTXP01DAJ8U.10.79.H02.1.454.CMB.2.raw
  modified_base (318)..(318): a, c, t, g, unknown or other
  misc_feature (318)..(318): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttggctgagctggttttcctgttgctattataaaggtgtccagtgtcaggtgaagctgggtggagtcgtgggggagcttggtcaagcctggagggtccctgagactctcctgtgcagcctcgtggacttcgcctcgtggattgacgttcagtgactactacatgaccgtgggtccncaggctccgagggggagggctgggagttgggtttccagttactatttactccgtaagttggtgataccatatactacgcagactcgtgtgaaagggccgaattccaacctatccgtaccgaaggggaaccaaacggacccaaagggaactacgacctagtacctttagacctaaatcgaaacctacccgtgccgaaggcccgaacgggaccacgggccgtaagtaacttacgttgttacgaacgaaacgtaacgttaaccccgttcgacccgttaagggtttaaccttaacccg

SEQ ID NO: 317665 - DNA, 540 bp, Homo sapiens
  misc_feature: GZ8MTXP01DJF2Q.10.79.H02.1.454.CMB.2.raw
  modified_base (360)..(360): a, c, t, g, unknown or other
  misc_feature (360)..(360): n is a, c, g, or t
  modified_base (412)..(412): a, c, t, g, unknown or other
  misc_feature (412)..(412): n is a, c, g, or t
  modified_base (487)..(487): a, c, t, g, unknown or other
  misc_feature (487)..(487): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccgccaggctccgagggagggctggagtggtttcatacatttancctaagtggtgataccatatactacgcagactctgtgaagggcatcacatcncaggacacgcaagactcatgacttgcaaatcgaacctccctgcgagccgaggaccacggccgttaatacttacgngttacgcgtaacgaacttaaccccggttcgaccttgggtttaactttaacccg

SEQ ID NO: 317666 - DNA, 548 bp, Homo sapiens
  misc_feature: GZ8MTXP01AOTR7.10.79.H02.1.454.CMB.2.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtctagcagcaactacgttgcctggtaccaacagaaacctggccaggcctcccgggctcctcatctatggtacatctagcagggccatggcatcccagacaggttcagtcggcaggtggggtctggggaacaggtccttcacctctacaccatcagcagactggagtctagtaagtattttgctagttgttattagttgtactagtactaatagtggtagtcgtacgtgggtacgttttggaccgtaggggaccaaggcgttgggagagtacgaaacgttaacgttggttaggctcgctaccagttcttcgttctttaac

SEQ ID NO: 317667 - DNA, 584 bp, Homo sapiens
  misc_feature: GZ8MTXP01E0WJU.10.79.H02.1.454.CMB.2.raw
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctcgtggtattgacgttcagtgactactacatgacctgggtccncaggctcgaggggagggctggagtgggtttccatactatttntccgtaagttggtgataccattataactacgacagtactcgtggtagaacggggccatttacccaccgtatcctcgaacgggacaaacgccaaaggactcgatgtaccttgacaaatcgaacctacccgtgacgcgccggaaggaccgaccggccgttaatacgttacgnggttcgaacgagtaacttaacccgtcgaccttaagggtttaactttaacccg

SEQ ID NO: 317668 - DNA, 585 bp, Homo sapiens
  misc_feature: GZ8MTXP01CC0CO.10.79.H02.1.454.CMB.2.raw
  modified_base (264)..(264): a, c, t, g, unknown or other
  misc_feature (264)..(264): n is a, c, g, or t
  modified_base (326)..(326): a, c, t, g, unknown or other
  misc_feature (326)..(326): n is a, c, g, or t
  modified_base (375)..(375): a, c, t, g, unknown or other
  misc_feature (375)..(375): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttgggtcaaggccgtggacgggtccctgagactctcctgtncagcctcgtggacttcgcctcgtggattgacgttcagtgactactacatcgacctgggtccncgaggcctccggagggggagggctggagttgggtttccatactatttanccgtaagtggtgataaccattactactacgcagactctggtagaacgggcctattaccacatccaccgagggaacaacgaccaaaggactcgactgtacttgactaaatcgaaccncctgcgacgccggagaccacggttccgtaatacttacgttggttacgcgaagtaaccgttacccgttcgaccgtttaaggttaactttaacccg

SEQ ID NO: 317669 - DNA, 661 bp, Homo sapiens
  misc_feature: GZ8MTXP01AJI1I.10.79.H02.1.454.CMB.2.raw
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggagggtccctgagactctcctgtgcagcctctggattcgcctcgtggattgacgttcagtgactactacatgacctgggtccncaggcctcgagggagggctggagtggttcatatattanctaagtgtgataccatactactacgcagactcgtaggaggaacgggcctattccgaacctattcccgtacccggaacggggaacccaaaccggacccaaaacggggtaaccctaccgtaacgttacgttaaccgtttagaacctaaaagttaccggaaacccctacccggtacggaccggaacgggaacccggaaacgggaccgaccgggttacccgttaagttacgttaccgttggttacggaacggtaacgtaaccgttaaccccggttcgttaccgtttgggtttaacctttaacccgg

SEQ ID NO: 317670 - DNA, 666 bp, Homo sapiens
  misc_feature: GZ8MTXP01C14SX.10.79.H02.1.454.CMB.2.raw
  modified_base (317)..(317): a, c, t, g, unknown or other
  misc_feature (317)..(317): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctctggattcgcctctggattgacgttcagtgactactacatgacctgggtccncaggctccgaggggagggctgggagttgggtttccatactatttatcctaagtggtnataccatatactacgcagacttctggtaggaaggggccctattacaccctatcccgtaccgaaggggaaccaaaccggcccaaaagggaacccttccaacgttacggtaacttttacgaacctaaaattacggaaacctaaccccgtggacccggaaacgggccccgggtaaaggacccgaacccggggcccgtttaaataacgtttaccgttgggttcggaacccggaaagtaaacccgtttaacccccgggttcgttaccccgttttaagggtttaaccttttaacccgg

SEQ ID NO: 317671 - DNA, 521 bp, Homo sapiens
  misc_feature: GZ8MTXP01BJIXE.10.79.H02.1.454.CMB.2.raw
  modified_base (196)..(196): a, c, t, g, unknown or other
  misc_feature (196)..(196): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcacacgaagggaaaggggagagctgctcagttaggacccagagggaaccatggaaacccagcgcagcttctcttcctcctgctactctggctccagataccaccggagaaattgtgttgacgcagtctccaggcacctgtctttgtctccaggggaanagccacgctctcctgcagggccagtcagagtcttagcagcaactacgttgcctggtaccaacagaaacctggccaggctcccgggctcctcatctatggtacatctagcaggccactggcatccagacaggttcagtcgcagtggtctgggaacagcttnactctcaccatcagcagactggagtctgaagtattttgctagttgtattattgtactagtctaatagtaggtaggtcgtaccgttgggtacttttgggccgtaggggaccaaaggtcgttaggagagtacaaacgacgttgttggctgcaccgattctgttcttc

SEQ ID NO: 317672 - DNA, 644 bp, Homo sapiens
  misc_feature: GZ8MTXP01D6OQ3.10.79.H02.1.454.CMB.2.raw
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggaggcttggtcaagccgtggacgggtcctgagactctctgtgcagcctcgtggactcgctcgtggattgacgttcagtgactactacatgaccgtgggtccncgaggcctacggagggggagggctgggaggttcgggtttaccattactattttactccgtaaaggttcggtaagactaaccctattactaactacggctaagtaccttgtaggtacggaaacggggtcctattaccgacctatccgaccgaagggaaccaaacgaccaaaggaactcaacttacgtactttagacctaaaagtcgaaacctaccgtgaccgaacggccggaaggaccgacggttaccgttaattacttacgttcgttacgaacgtaacgtaaccttaccccggttcttaccgtttcggtttaactttaacccg

SEQ ID NO: 317673 - DNA, 552 bp, Homo sapiens
  misc_feature: GZ8MTXP01ASZI0.10.79.H02.1.454.CMB.2.raw
  modified_base (202)..(202): a, c, t, g, unknown or other
  misc_feature (202)..(202): n is a, c, g, or t
  modified_base (412)..(412): a, c, t, g, unknown or other
  misc_feature (412)..(412): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccacgctctcctgcagggccagtcagagtcttagcagcaactacgttgcctaggtaccaacagaaacctggccaggcctcccgggctcctcatctatggtacatctagcagggccacgtggcactcccagacaggttcaggtcggcaggtgggtctggggaacagtcttcactctaccacatcagacagactggagtacgtagaagttntttgctagttgttattagtgtacgagtactaatagtggtacgtcgtacgttgggtcctttgggaccgtaggggacctaagcgttaggagagtacgaaacgttacgttggacgtctgaaccgtacctattctcgttcttcc

SEQ ID NO: 317674 - DNA, 561 bp, Homo sapiens
  misc_feature: GZ8MTXP01DDHIM.10.79.H02.1.454.CMB.2.raw
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctcgtggattcgcctctggattgacgttcagtgactactacatgacctgggtcccnccaggcctccgaggggagggctggagtgggtttccagtacntttancctagtgtgataccatatactacgnagactcgtgtgaagggccgtattacacctatcctccgaagggaccaacgaccaaaggaacctcaactgactttgacaaatacgaaccaccctgcgagccgaggacacggcgtaatgttacgttgttgcgaacgtaacttaaccccgttcgacctttggttctttaaccg

SEQ ID NO: 317675 - DNA, 589 bp, Homo sapiens
  misc_feature: GZ8MTXP01BMVIX.10.79.H02.1.454.CMB.2.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (540)..(540): a, c, t, g, unknown or other
  misc_feature (540)..(540): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttggctgagctggtttcctgtgctattataaaggtgtccagtgtcaggtgaagctggtggagtcgtgggggaggcttggtcaagccgtggacgggtccctgagtactctcctgtgcagcctcgtggtattcgcctgtggtattgacgttcagtnactactanatcgacctggccncaggctcgaggggaggctggagttggttccagtactatttactccgtaaggtgtgactaccgtatactactacgcagtcctgtgtaggaacgggcctattaccgacctattcccgaccgagggaaccaaacgccaaaggacctcgaacttcgtaacctttgaacctaaagtcgaaacctcccgtaggcgacggccgaaggaccgacgggttctatacttcgngttcgaacgacgtaaccgttacccgtggttaccttgggtttaacttccg

SEQ ID NO: 317676 - DNA, 579 bp, Homo sapiens
  misc_feature: GZ8MTXP01BMFYA.10.79.H02.1.454.CMB.2.raw
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctggagggtccctgagactctcctgtgcagcctctggattcgcctctggtattgacgttnagtgactactacatgacctgggtccncaggctcgagggagggctggagtggttccatacatttancctaagtgtnataccatatactacgcagactcgtgtgagggcatcaccatcncaggacaacgaccaaggactacactgacttgactaaatacgaacctaccctagccgacggcccggaacgggaccaccgggaccgttaaacgtaagttaaccttggttacgaacggaaacgtaaccgttaaaccccgttcggttacccgtttgggtttaactttaacccg

SEQ ID NO: 317677 - DNA, 590 bp, Homo sapiens
  misc_feature: GZ8MTXP01CSBUA.10.79.H02.1.454.CMB.2.raw
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggacgggtccctgagactctcctgtgcagcctctggattcgcctcgtggtattgacgttcagtgactactacatcgaccgtgggtcccnccgaggcctaccggagggggagggctgggagtgggtttcatactntttatcctaagtgtgactacatatacacgacagactctggtgagggccgattacacctactcctaccgagggaccaacgaccaagggaacctcactcgtactttcgactaaatacgaacctacctcgacgcgccggaacggcgaccggcgttaatcttaacgttgttacgaacggtaagtaaccgttacccggttcgttaccgttggtttaactttaaccg

SEQ ID NO: 317678 - DNA, 557 bp, Homo sapiens
  misc_feature: GZ8MTXP01EHF6F.10.79.H02.1.454.CMB.2.raw
  modified_base (319)..(319): a, c, t, g, unknown or other
  misc_feature (319)..(319): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccnccaggctcgaggggagggctggagtgggtttccatacatttatcctaagtggtgataccatatactacgcagactctgtgaagggccattcaccatcncaggacaacgccaaggactcaactgactttgactaaatacgaacctcccgtgccgaggcccgaggaccgacggaccgtataattacgttgttcgaacgaagtaacgttaaccccgttcgccctttggttaactttaaccg

SEQ ID NO: 317679 - DNA, 708 bp, Homo sapiens
  misc_feature: GZ8MTXP01ANMF3.10.79.H02.1.454.CMB.2.raw
tcagcatagtagtgcacgaccggtgctcgatttagtgtcacacgaaggggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcttggtcaagccgtggagggtccctgagacttctcctgtcgcagtcctcgtggattcgctctggatgacgttcagtgactactacatcgacctgggtcccgcgaggctaccggagggggacgggtctgggtaggttcgggtttaccaattactattttacgtccgttaaaggttcggtgtactaaccctattactaccttacggctaaacggacttcgtggtaacggaacggggtaccctacgttacccgacctattacccgtacccggaaggggaaacccaaacgggtacccaaaacgggtacctaccgtacttacggttaacctttagaacctaaactaccggaaaccctaccccgtggacccggaacgaacccgggaaaggttacccgaaaccggggccgttaaataacgtttaccgttggttcgaacgtaacgtaaaccgttaaccccggtgttacccgttaaggtttaacttaacccgg

SEQ ID NO: 317680 - DNA, 529 bp, Homo sapiens
  misc_feature: GZ8MTXP01DPXSX.10.79.H02.1.454.CMB.2.raw
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctggagggtccctgagactctcctgtgcagcctctggattcgcctntggattgacgttcagtgactactacatgaccctgggtccnccaggcctcgaggggaggctggagtgggtttccatacatttatcctaagtggtgataccatatactagcagactctgtgaagggcattcacatcncaggacaacgcaaggactnactnacttgacaatagaacctccngcgagcgagacacggcgtatacttacgttgttgcgaagtaactaccgtcgttcttaaggttaattaaccg

SEQ ID NO: 317681 - DNA, 561 bp, Homo sapiens
  misc_feature: GZ8MTXP01CJM50.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagcttggtcaagcctggagggtccctgagactctcctgtgcagcctctggattcgcctctggattgacgttcagtgactactacatgacctgggtcccgccaggctccgagggggaggggctgggacgttgggtttccatactatttatcctaagtggtgataccatatactacgcagactctgtgaacgggccgattcaccatccaccgagggaccaacgaccaaaggactcactacgacttgacaaatcgaacacccgtgccgagccggagacacggccgtatattacgttgttcgaacgagtaactacccggtcgaccgttaacggttaactttaacccg

SEQ ID NO: 317682 - DNA, 636 bp, Homo sapiens
  misc_feature: GZ8MTXP01AJJGU.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtggaggtccctgagactctcctgtgcagcctcgtggattcgcctcgtggattgacgttcagtcgactactacatcgacctgggtcccgccgaggcctccggagggggaggggtctgggaggttgggtttaccattacgtatttatccgtaagtcggtgactaccatactactacgacagtactctggtagaacggggcctattaccacctatcctaccgaagggaaccaacgaccaaaggactactactagtactttgactaaactacgaaccaccctaggaccgacggcccggaaggaccgaccgggttaccgtaaattaacgttaccgttggttacggaacgaacgtaaaccgttaaccccggttcgttaccccgttaagggttttaacctttaacccg

SEQ ID NO: 317683 - DNA, 763 bp, Homo sapiens
  misc_feature: GZ8MTXP01EURRH.10.79.H02.1.454.CMB.2.raw
  modified_base (271)..(271): a, c, t, g, unknown or other
  misc_feature (271)..(271): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggaggcttggtcaagccgtggacgggtccctgacgactctcctgtgcagcctntggattcgcctgtggattggacgttcagtgacctactacgatcgacccgtgggtccccgccgacgggccctaccggaaggggggaacggggtcttagggggtaggtttcggggtttacccaagttactaagttttactcccgttaaagggttgggtaacgtaaacttaaccctaatttacgtaacccttaacgcctaaggtaccttacgttagggtaacggaacgggggtcccttaaatttacccgaacccttacgtacccgtacccgaaacgggggaacccaaaccgggacccaaaagggtaacccgttccaaacgttcgtaactttcgaaacctaaaacgttacgaaacccacccgtacggccggaacggaaccgggaacggaccgaccgggttccgtaaagtttacgttacgttcggttaggaaccggtaagtaacccgtttaaccccggttcgttacccggtttaagggttttaacctttaaccccgg

SEQ ID NO: 317684 - DNA, 675 bp, Homo sapiens
  misc_feature: GZ8MTXP01BDC04.10.79.H02.1.454.CMB.2.raw
  modified_base (183)..(183): a, c, t, g, unknown or other
  misc_feature (183)..(183): n is a, c, g, or t
  modified_base (320)..(320): a, c, t, g, unknown or other
  misc_feature (320)..(320): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtntccagtgtcaggtgagctggtggagtcgtgggggagcttggtcaagcctggacgggtcctgagactctcctgtgcagcctgtggattcgcctcgtggtattgacgttcagtgactactacatgaccgtggggtcccncgagggcctccggagggggacgggctggggagttcggggtttaccattactatttactccgttaaagggtggtgactaaccattactaccgtacgctaacgtacttcgtggtagggaacggggtccctatttacccgaacctatccctaccggaacgggaaccaaaccgaccccaaaggggtaacccttccgaaccttacgggtaacctttggaacctaaattcggaaaccctaccccgtggaccgacggaaccggaacgggaccaccgggccgttaaatactttaccgttggttacgaacgaacgtaaccttaaccccggttcgttacccgtttaagggttaactttaacccgg

SEQ ID NO: 317685 - DNA, 577 bp, Homo sapiens
  misc_feature: GZ8MTXP01AC4O6.10.79.H02.1.454.CMB.2.raw
  modified_base (319)..(319): a, c, t, g, unknown or other
  misc_feature (319)..(319): n is a, c, g, or t
  modified_base (380)..(380): a, c, t, g, unknown or other
  misc_feature (380)..(380): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctcgtggattcgcctcgtggattgacgttcagtgactactacatgacctgggtccnccgaggctccgagggggagggctgggagttgggtttccatactatttactcctaagtggtnataccatactactacgcagactctgtaggaacgggccgattccacctatccgtaccgagggaaccaacgaccaaaggacctcactcgtactttgacaaagtcgaaacctcccgtgccgaggccgaaggaccacgggccgtaatacgttacgngttgaacgagtaacgttacccgttcgccttggttaactttaaccg

SEQ ID NO: 317686 - DNA, 706 bp, Homo sapiens
  misc_feature: GZ8MTXP01DTS5Y.10.79.H02.1.454.CMB.2.raw
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagccgtggacgggtccctgagactctcctgtgcagcctctggacttccgcctgtggtattgacgttcagtgactactacatcgaccgtgggtccncgaggcctcggagggggagggctgggagtggtttccatactattttactccgtaagtggtgactaccatactacgtacgcagtactcgtggtacggaacgggtcctattaccgacctattcccgaccggaaacgggaacaaaccggacccaaaggtaacccttacgaacgttcggtaacctttacggaactaaaacgttaccggaaaccctccccgtaggaccggacgggaacccggaacggggacccgtaaccgggggttaccctttaaagttaccgtttaacggttcgggttacgggtaaccgtaaaacggttaaacccgtttacccccgggtttacggttaccccgttttaaggggttttaaccctttaacccggg

SEQ ID NO: 317687 - DNA, 625 bp, Homo sapiens
  misc_feature: GZ8MTXP01CFTXV.10.79.H02.1.454.CMB.2.raw
  modified_base (324)..(324): a, c, t, g, unknown or other
  misc_feature (324)..(324): n is a, c, g, or t
  modified_base (565)..(565): a, c, t, g, unknown or other
  misc_feature (565)..(565): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctgggtggagtcgtggggggagcgttgggtcaaggcctgggacgggtccctgagactctcctgtgcagcctctggattcgcctctggattgacgttcagtgactactacatgacctgggtccncgaggcctccgagggggagggctggggagttggggtttccagttactattttactccgttaaaggttggtgaataacccaattactactacgcaacgtacttcgtagtaggaacggggtcctattaccaacctatcctaccgaagggaaccaaacggacccaaagggtaacctcaacttgtaacctttgaacctaaagtacgaacctacccgtgacgacgccgaaggacgacggcgtaatnttacgttggttcgaacgaagtaaccttaacccggttcgaccgttggtttaactttaaccg

SEQ ID NO: 317688 - DNA, 569 bp, Homo sapiens
  misc_feature: GZ8MTXP01CEZ7N.10.79.H02.1.454.CMB.2.raw
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagctggtggagtcgtgggggaggcttggtcaagccgtggacggtccctgagactctctgtgcagcctctggattcgcctcgtggattgacgttcagtgactactacatgacctgggtccnccaggctccgaggggagggctggagtggttcatactatttancgtaagtgtnataccatatactacgnagtactcgtgtagaacgggccattccaacctatccgacccgagggaaccaacgaccaaaggaacctcgactagtacctttgaacaagtacgacctacccgtgccgaacgccgtaggacacgggcgttaatnttacgngttgaacgtagaaccttaccggtcaccgttggttaacttaaccg

SEQ ID NO: 317689 - DNA, 597 bp, Homo sapiens
  misc_feature: GZ8MTXP01DULTC.10.79.H02.1.454.CMB.2.raw
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctctggacttcgcctntggtatgacgttcagtnactactacntcgacctgggtccncgaggcctcgaggggaggctggngttggttccatactatttactccgtaagtgtgataccaatactactacgcagtactcgtaggtagaacgggtcctaattccaactattccaccgaaagggaccaaaccggaccaaaggtaaaccctcgaacttcgtaactttgaactaaagtacgaacctacccgtgaccgagccgaaggcaccgggttctattacttacgttgttacgaacgtaagtaaccgttacccgttcgacctttggttaactttaaccg

SEQ ID NO: 317690 - DNA, 601 bp, Homo sapiens
  misc_feature: GZ8MTXP01CH09N.10.79.H02.1.454.CMB.2.raw
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (548)..(548): a, c, t, g, unknown or other
  misc_feature (548)..(548): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctgggtggagtcgtgggggagcttggtcaagccgtggacgggtccctgagactctcctgtgcagcctcgtggacttcgcctcgtggattgacgttcagtgactactacatcgaccgtgggtcccnccgaggcctccggagggggagggctgggagttgggtttccagtactatttanccgtaagtgtgataccatatacctacgcagtactcgtggtggaacgggcctattccacctatccgtaccgaagggaaccaacggacccaaaggtaaccctcgaacctagttacttcgaactaaataccgaacctcccgtgacggcgcggaggaccaccggttctaatnttacgttgcgaagtaacgtaacttacccgtcgttaccgttgtttaactaaccg

SEQ ID NO: 317691 - DNA, 558 bp, Homo sapiens
  misc_feature: GZ8MTXP01EC4XD.10.79.H02.1.454.CMB.2.raw
  modified_base (195)..(195): a, c, t, g, unknown or other
  misc_feature (195)..(195): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcacacgaagggaaggggctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaacctggccaggctcccgggctcctcatctatggtacatctagcagggccactggcatcccagacnggttcagtggcagtgggtctggggacagaacttcnctctcaccatcagcagactgagtctgtaagtattttgctagtgtattagttgtacagtctaaagttagttagggttacggtcgtaacccgttggggttacgttttacgggccgtaagggggaccctaaggccgttaaggaaggatacgaaaccggtaagtcggttagggcttgctacaatctgttcttcgaacttcccg

SEQ ID NO: 317692 - DNA, 650 bp, Homo sapiens
  misc_feature: GZ8MTXP01BLXG3.10.79.H02.1.454.CMB.2.raw
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggagcttgggtcaagccgtgggagggtccctgacgactctcctgtgcagcctctggattcgcctctggattgacgttcagtgaactactacatcgacctggggtcccnccgaggcctaccggaagggggaacgggggctggggaggttggggttttccagttactagtttatcccgtaagggttgtgtaatacccattactactacgctacgctgtgtagaacgggacctaagttacaacctacgtaccgtaccgaacgggaacaaaccgacccgaaacgggtaccttaccgtaactacgtaactttacgacaaaacgtcgaaacctacccgagaccgacgaaccggagaccgacggttccgtaatacgttagttgttcgaacgtaagtaacgttaccccgttcgttaccgttaacggttaactttaaccg

SEQ ID NO: 317693 - DNA, 654 bp, Homo sapiens
  misc_feature: GZ8MTXP01B3RMO.10.79.H02.1.454.CMB.2.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (385)..(385): a, c, t, g, unknown or other
  misc_feature (385)..(385): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgttagctattataaaggtgtccagtgtcaggtgaagctgggtggagtcgtgggggaggcttggtcaagccgtggagggtccctgagactctcctgtgcagcctnggattcgcctntggattgacgttcagtgactactacatcgaccgtggggtcccgccgaggccctaccggagggggtaaggggctgggaggttggggtttaccagtttactattttacnccgttaaaggttggtgaactaccattactacgtacgcagtacctcgtaggtaggaacgggccctattacccacctactccaccgaacgggacaaaccgacccaaagggtaacccttacgaacttcgtaactttcgacctaaatcgaaacctacccgtgaccgacgccggaaggttaccacgggttaccttaagtacgttacgttggttacgaacgtaaagtaaccgttaaccccggttcgttacccgtttaaggtttaacctttaaccg

SEQ ID NO: 317694 - DNA, 565 bp, Homo sapiens
  misc_feature: GZ8MTXP01CENTI.10.79.H02.1.454.CMB.2.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggaggtccctgagactctcctgtgcagcctntggattcgcctntggattgacgttnagtnactactacatgaccgtgggtcccnccaggctccgaggggagggctggagtgggttccatacatttancctaagtggtnataccatatactacgcagactctgtgagggccgattcacatcncgaggacacgccaaggacncactgctttaaagctaaatcgaaccaccccgtgccgacgccggaaggaccgaccgggccgtaagtacttacgttgttacgaacggtaagtaaccttaccccggttcgacccgttggttaacgtttaacccg

SEQ ID NO: 317695 - DNA, 589 bp, Homo sapiens
  misc_feature: GZ8MTXP01E3R42.10.79.H02.1.454.CMB.2.raw
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccacgctctcctgcagggccagtcagagtcttagcagcaactacgttgcctggtaccaacagaaacctggccaggcctcccgggctcctcatctatggtacatctagcagggccacgtggcatcccagacaggttcagtcggcaggtggtctggggaacaggtccttcactctcaccatcagcagactggagtctaggtaagtattttgactagttagttatttatgtacgagtactaatagtgggtaagtcgtaccgttgggtacgtttcgggaccggtagggggaaccaaggtcgttagggaaacgttacgttaaacgaaacggttaacgttgggttacgggtctacggtcctaccgtacgttaccttcggttcctttaacccg

SEQ ID NO: 317696 - DNA, 711 bp, Homo sapiens
  misc_feature: GZ8MTXP01DMDFU.10.79.H02.1.454.CMB.2.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcttgggttttccttgttgctattaataaaggtgtccagtgtcaggtgaagcgtggtggagtcgtgggggagtcttggtcaagccgtggacgggtccctgagctctcctgtcgcngcctgtggacttcgcctcgtggtattgacgttcagtgactactacagtcgacccgtgggtcccncgaggccgtaccggaagggggtacgggggtcttaggggtaggtttcggggtttaccaagtttaacgtagtttttactcccgttaaagggttgggttaacaaactttaaccccaatttaacgtaacccgtaacggctaacggtaccttcgtaggtacgggaacggggtccctaattacccaccgtacttcccgaccggaacggggaacccaaaccgaccgaaaacgggtaaccctcgtaaacttacggtaacctttagaacctaaataccgaaaccctcccgtagcgacggaaccgaacggaccgacgggttaccttaatacgttacgttgttacgcgtaaacgtaacgttacccgtcgttacgttgtttaacttaaccg

SEQ ID NO: 317697 - DNA, 652 bp, Homo sapiens
  misc_feature: GZ8MTXP01AUFXN.10.79.H02.1.454.CMB.2.raw
  modified_base (182)..(182): a, c, t, g, unknown or other
  misc_feature (182)..(182): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
  modified_base (456)..(456): a, c, t, g, unknown or other
  misc_feature (456)..(456): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgtgctattataaaggtntcagtgtcaggtgaagctggtggagtcgtgggggagcttggtcaagccgtggacgggtccctgagactctcctgtncagcctctggattcgcctctggattgacgttcagtgactactacntcgacctggggtcccnccgaggcctccggaagggggaggggctggggtagttgggtttccagtactagtttactccgtaaagttcgggtntaataccctattactacgtacgntaacgtacctgtaggtggaaacgggcctattacccacctntaccgaccgaagggaaccaaacgccaaagggaaacctctaacgtctaactttcgacctaaatacggaaccaccccgtggaccggaggccggaacggcgaaccgggttacgttacttaacgtttacgttgttcgggaaccgtaaacgtaacccggtttaacccggttcgttaccgtttcggtttaaactttaacccg

SEQ ID NO: 317698 - DNA, 537 bp, Homo sapiens
  misc_feature: GZ8MTXP01AZMTA.10.79.H02.1.454.CMB.2.raw
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctntggattcgcctctggattgacgttcagtgactactacatgacctgggtccncaggctcgagggaggctggagtggttccatacatttanctaagtgtnataccatatactacgcagctntgtgacgggcattcacntcacgaggacaacgccaagactcactgtacttgacaatcgaactccctgcgagccggagacgacggccgtaatacgttacgttgttggaacgacgtaacttaccccgttcgccgttaaggttaacctttaaccg

SEQ ID NO: 317699 - DNA, 582 bp, Homo sapiens
  misc_feature: GZ8MTXP01B302I.10.79.H02.1.454.CMB.2.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctccngtgcagcctntggattcgcctctggattgacgttcagtgactactacagtgacctggggtcccnccgaggcctccggagggggagggggtctggggtagttggggtttaccattactatttanccttaagtgtgatacccatactactacgctacgctcgtgtggacgggcctagttaccacctatcctccgagggaccaacgccaaggactcactgacttgactaaatcgaacctccctgcgagccggagacgacggccgtagttacttacgttggagcgaagtaactaacccggttcgttccgttaacgtttcgtttaaccg

SEQ ID NO: 317700 - DNA, 553 bp, Homo sapiens
  misc_feature: GZ8MTXP01DRB79.10.79.H02.1.454.CMB.2.raw
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggttaagctggtggagtcgtgggggaggcttggtcaagcctgggagggtccctgagactctcctgtgcagcctctggattcgcctctggattgacgttcagtgactactacatcgacctgggtccncaggctccgagggaggggctgggagtgggttcagtactatttancctagtggtnaataccatactactacgcagactctgtgaagggtcattcaccatctaccgaggacaacgaccaaagaactcactgtacttgacaaatcgaaaccnccctgcgagccgaaggacacgggccttatattacttgttgacgaagaaacgtaacccgttcgccttaggttaacttcgttaacg

SEQ ID NO: 317701 - DNA, 654 bp, Homo sapiens
  misc_feature: GZ8MTXP01ERVBK.10.79.H02.1.454.CMB.2.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttgggtcaagccgtggacgggtccctgagactctcctgtgcagcctntggattcgctctggnttgcgttnagtgactactacatcgaccgtggtccgccgaggcctacggagggggacgggctgggagttgggtttaccagttactattttacgtccgtaaagggtgtgtactaccgtattactactacggctaagtaccttcgtaggtagggaaacgggtccgtaatttacccaacctactccgtaccggaacgggaaacaaaccggacccaaaacggggtaacctctaaacgttcgtaacgtttgaaacgtaaacttacggaaacctcccctaggccgacggaaccggaacgggacctaccgggttacctaagttattacgttgttagaacgagtaacttacccgtcgccgtttaaggttaacttaacg

SEQ ID NO: 317702 - DNA, 659 bp, Homo sapiens
  misc_feature: GZ8MTXP01CU3P8.10.79.H02.1.454.CMB.2.raw
  modified_base (198)..(198): a, c, t, g, unknown or other
  misc_feature (198)..(198): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcacacgaaggggaaagggggctgctcagttaggacccagagggaaccatggaaaccccagcgcagcttctcttcctcctgctactctggctcccagataccaccggagaaattgtgttgacgcagtctccaggcaccctgtcttgtctccgaggggaaangccacgctctcctgcagggccagtcagagtcttagcagcaactacgttgcctaggtaaccaaacgagaaacctggacccaggcctccccgggctcctcattcgtatggtacatctagccgaggggcccacgtggccactccccgaaggaccgtaggttcaggtggacgtaggtggggtcnggggacagtaaccttcgctctacaacctatcgaggcaaggtactaggagtacgtagtaagttagtttagacgttagttagttattagttgtactagtactaagttaggtaggtacggtcgtaccggttgggttacgtttacgggaccgtaaggggtaacccaggtacggttaaggaacgttaacgttaaaccgaaacggtaaccggtggttacggttcttaccggtaacctaccgttaacgtttccgttacgtttacctttaaccgttaaccgtttccccg

SEQ ID NO: 317703 - DNA, 619 bp, Homo sapiens
  misc_feature: GZ8MTXP01A731Z.10.79.H02.1.454.CMB.2.raw
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (511)..(511): a, c, t, g, unknown or other
  misc_feature (511)..(511): n is a, c, g, or t
  modified_base (593)..(593): a, c, t, g, unknown or other
  misc_feature (593)..(593): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctgggtggagtcgtgggggaggtcgttggtcaagccgtgggacggtccctgagactctcctgtgcngcctcgtggacttcgcctcgtggtattgacgttcagtnactacacatgacctgggccncaggcctccggagggggagggctagggaggttgggttccagttactatttactccgttaagtggtgactaccattactactacgctagtctcgtggtaggaacggcctattaccacctattcccgaccgagggaacccaacgtacccaaaggacctcgtactgtacttagactaaaagtcgaaccncccgtgccgaacggcccgaagaccgtacggccgttaattacgttacgttggttacgcggtaacttaaccgttaccccggttnttacccgtttggtttaaccttcccgg

SEQ ID NO: 317704 - DNA, 537 bp, Homo sapiens
  misc_feature: GZ8MTXP01EJL0F.10.79.H02.1.454.CMB.2.raw
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (488)..(488): a, c, t, g, unknown or other
  misc_feature (488)..(488): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtaggggaggcttggtcaagcctggagggtccctgagactctcctgtgcagcctctggattcgcctctggattgacgttcagtgactactacatcgacctgggtccnccgaggcctcgaggggaggggctggagtggtttcatacntttatcctaagtggtgataccatatactacgcagactntgtgaaggcatcacatcncaggacaacgcaaaggactcactgacttgacaaatacgaactccctgcgagccgagacacggcgtaatattacgngttacgcgaagtaacttaaccccggttgcccgttggttaactttaaccg

SEQ ID NO: 317705 - DNA, 785 bp, Homo sapiens
  misc_feature: GZ8MTXP01BC4KE.10.79.H02.1.454.CMB.2.raw
  modified_base (336)..(336): a, c, t, g, unknown or other
  misc_feature (336)..(336): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggacggtccctgagactctcctgtgcagtcctctggacttccgccttcgtggattggacgttcaagtcgaactactacagtcgacccgtgggggtccccnccgaggcccgtcggaagggggacggggctggggtaggttcgggtttaccattacgtatttacgccttaaggtggtgtaactacctaatactaccgtacgcgtaagtccttacgtgggtacggaacggggtccctaagtttacccaaaccgtattcccgtacccggaaaggggaaccccaaaccgaaccccgtaaagggtaaacccgttccaaccgttacggttaaaccctttacggaaaccctaaaacgttacccgggaaaccctacccccggtaagggcccggaaccggggaaccccgggaaaccggggaacccggtaacccggggttaaccgttaaacttaacgtttaacccgttgggttaccggaaaccgggtaaacgttaaacccgtttaaaccccccggggttcgttaaccccgtttaaggggttttaaaccctttaaccccgg

SEQ ID NO: 317706 - DNA, 738 bp, Homo sapiens
  misc_feature: GZ8MTXP01EMEY3.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtcctgagactctcctgtgcagcctctggattcgcctcgtggtattgacgttcagtgactactacatggaccctggggtccgccgaggcctaccggagggggagggctgggagttggggtttaccagttactattttagtcccgttaaaggtcgggtgaacttaacccattaactacctacggactaacggtacttcgtaggtacggaaacggggtccctaatttccgaaccctattcccgtacccgaacggggaaaccaaaccgggaccccaaaaggggtaaacccttacaaaccgttacggtaaactttcggaaccaaaagttacggaaaccctaccccgttaggacccggaacggaaccccgggaagggacccgtaaacccgggggacccgtttaaattaacgtttaccggttgttacgggaacccggtaaaaggtaaaccgtttaaaccccccgggtttggacccccgttttaagggttttaactttaaccccgg

SEQ ID NO: 317707 - DNA, 574 bp, Homo sapiens
  misc_feature: GZ8MTXP01BKITV.10.79.H02.1.454.CMB.2.raw
  modified_base (405)..(405): a, c, t, g, unknown or other
  misc_feature (405)..(405): n is a, c, g, or t
  modified_base (442)..(442): a, c, t, g, unknown or other
  misc_feature (442)..(442): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgtgctatataaaggtgtcagtgtcaggtgaagctggtggagtcgtgggggagcttgggtcaagccgtgggagggtccctgagactctcctgtgcagcctctggattcgcctgtggattgacgttcagtgactactacatgaccgtgggtcccgccaggcctccggagggggaaggggctggggaggttgggtttccagttactatttactccgtaaagtggtgataccattactacgtacgnagacttcgaggtggaacgggccagttccacctatccnccgaaggacacgacaaggactcactagtacttanacaagtacacctaccacgcgcgaacgacggacgacgacgtagtattacgttgttgaacgacgtaacgtaccgtaccgttacgttcgttaacgttaacg

SEQ ID NO: 317708 - DNA, 693 bp, Homo sapiens
  misc_feature: GZ8MTXP01DD9U9.10.79.H02.1.454.CMB.2.raw
  modified_base (297)..(297): a, c, t, g, unknown or other
  misc_feature (297)..(297): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctatggattcgcctctggattgacgttcagtnactactacatgacccgtgggtcccaccgacggcctccgagggggaggggctggggaggttcgggtttaccattacgtatttttaactccgttaaggttgggttgtaacttaacccgtaattaactaaccgtaaccgacgaacggtaccttcgtaggtacgggaaacggggtcccgttaaatttcccgaaccctagttcccgtacccggaaacggggaaccaaacccggaccccaaaggggtaaacccctctaacgttcgtaacctttgaactaaaatcgtaacccaacccgtgaccgaggcccgaaggaccgtaccggaccgttaaatacgttacgttgttacggaaccgaagtaacgttaaccccggttcttacgtttaacggttaacttaaccg

SEQ ID NO: 317709 - DNA, 683 bp, Homo sapiens
  misc_feature: GZ8MTXP01BAE5O.10.79.H02.1.454.CMB.2.raw
  modified_base (329)..(329): a, c, t, g, unknown or other
  misc_feature (329)..(329): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctaattaataaaaggtgtccagtgtcaggtgaagcgtgggtggagtcgtgggggagcttggtcaagccgtggacggtccctgacgctctctgtgcagcctgtggacttcgcctcgtggtattgacgttcagtgactactacagtcgaccgtgggcccncgaggcctaccggagggggagggctgggagttggttaccatactattatccgtaagtggtnactacctatactacgtacgcacgtactcgtaggtacggaaacggggtccctagtttaccccaacctaacgtcccgtaacccggaacggggaaacccaaaccggaaccccaaaggggtaaacccttccgtaacgttaccgttaacgtttacgaaacctaaaagtaccgaaaccctaccccggtagacccggaacggccggtaacgggaccgtaccgggttacgtaattacgttacgttggttacgaacgtacgtaaccttaccccggtgttaccctttaaggttaacttaaccg

SEQ ID NO: 317710 - DNA, 537 bp, Homo sapiens
  misc_feature: GZ8MTXP01AMSNZ.10.79.H02.1.454.CMB.2.raw
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctctggattcgcctctggattgacgttcagtnactactacatgacctgggtccncaggctccgagggagggctggagtggttcatacatttanctaagtgtgataccgatactactacgcagactcgtgtgacgggccgattcacatcctaccgaggacaacgcaaggactcactgtacttgacaaatcgaacctacccgtgaccgcgccgaagacgacgcgtaatacttacgttgttcaacgagaactaacccgtcgcctgttaacttaaccg

SEQ ID NO: 317711 - DNA, 653 bp, Homo sapiens
  misc_feature: GZ8MTXP01BHLEG.10.79.H02.1.454.CMB.2.raw
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (403)..(403): a, c, t, g, unknown or other
  misc_feature (403)..(403): n is a, c, g, or t
  modified_base (568)..(568): a, c, t, g, unknown or other
  misc_feature (568)..(568): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggaggtccctgagctctctgtgcagcctctggattcgcctcgtggattgacgttcagtgactactanatgaccgtgggtcccncgaggcctccggagggggacgggcgtgggaggttgggtttccagtactagtttatccgtaagtgtgactacctatatacacgcanactcgtagtagaacgggcctagttccacctattccgaccgaacgggaacctaaaccggaccaaacggggtaacctacaacttacggtaactttacgaacctaaagtaccgtaaacctccccgtagaccggaacggaaccccggtaaggggacccgtacccggggngtttaaactacgttacgttcggttacggaacgtaacggtaacttaaccccggtcgttaccgtttaacgggtttaactttaacccg

SEQ ID NO: 317712 - DNA, 843 bp, Homo sapiens
  misc_feature: GZ8MTXP01ADW4K.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagctgggtggagtcgtgggggagtcgttggtcaagccgtggacgggtccctgagactctcctgtgcagcctcgtggtacttccgcctcgtggtattgacgtttcaggtcgactactacagtcgaccgtggggtccccgccgtagggccctaccgggaaggggggtaacggggtcgtagggggtacggtttcggggtttaccaagtttaactagtttttaacgtcccgttaaagggttcgggtaagtaaactaacccgtaattaacgttaaccgttaacgactaaacgtacccgtttagttcggtaacggggtaaccgggggtccctagtttaccccaaccctacgtttacccgaccccggaagggggaaaccctaacccgggaacccctaaaacggggtaaccttaccccaaacgtttaccgggttaaacctttggaaacccttaaaacggttaccggaaaaccccttaccccggtagggaccccggacgggaaccccgggtaaggggttaaaccccgaccgggggttaaccctttaaagttaaccgtttaaccgggttggttaccggaacccggtaaaggttaaccccgtttaacccccggttcggttacccgttttaacgggttttaacctttaaccccgg

SEQ ID NO: 317713 - DNA, 750 bp, Homo sapiens
  misc_feature: GZ8MTXP01AP12S.10.79.H02.1.454.CMB.2.raw
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggaggcttggtcaagcctggacgggtccctgagactctcctgtgcagcctcgtggattcgcctntggatgacgttcagtgactactacatcgacctgggccncaggcctcgaggggacgggctggggagttgggtttccattacgtattttactccgttaagggtcggttgaacttaacccaattaactaaccgttacggcctaaaggtaaccttcgttacggttaggaaacgggggtccccgtaatttacccgaacccttaacttaccctacccggaaacgggggtaaccaaaccgggaccccaaaacggggtaaacctacctaaccgttacgggtaaccttttacggaaaccgtaaaacttaaccgaaacccgtaccccgtaggacccggaggaaccccggaaggggacccgaacccgggttcccggttaaattaacgtttaacccgttgggttacgaaccgggttaacgtaaaccgtttaaacccccgggtttcgggaccccgttttaagggtttaaccttttaaccccgg

SEQ ID NO: 317714 - DNA, 496 bp, Homo sapiens
  misc_feature: GZ8MTXP01E0K4W.10.79.H02.1.454.CMB.2.raw
  modified_base (199)..(199): a, c, t, g, unknown or other
  misc_feature (199)..(199): n is a, c, g, or t
  modified_base (357)..(357): a, c, t, g, unknown or other
  misc_feature (357)..(357): n is a, c, g, or t
  modified_base (422)..(422): a, c, t, g, unknown or other
  misc_feature (422)..(422): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccagctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggaacngcttcactctcacatcagcagactggagtctgaagtattttgctagtgtattatgtcagcaatanggtagtcactgggctttggccagggggccaagcttgganagtcaacgacgttgnggtcngcncnttctgttctn

SEQ ID NO: 317715 - DNA, 624 bp, Homo sapiens
  misc_feature: GZ8MTXP01A7GNN.10.79.H02.1.454.CMB.2.raw
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtggagggtccctgagtactctcctgtgcagcctctggattcgcctctggattgacgttcagtcgactactacatcgacctggggtccncgaggctccgagggggagggctgggagttgggtttccagttactattttacnccctaaggtggtgactaccattatactacgcagactcgtggtagacgggcctattcacctatcctaccgagggaaccaaccgaccaaagggacctcactacgtactttcgactaaagtcgaaacctccccgtagacccggaggaacccggaacggaccgaccgggttccctaaagttacttaccgttgttacgaacggtaagtaaccgttaaaccccggttgttaccccgttggttaactttaacccgg

SEQ ID NO: 317716 - DNA, 749 bp, Homo sapiens
  misc_feature: GZ8MTXP01CN43A.10.79.H02.1.454.CMB.2.raw
  modified_base (276)..(276): a, c, t, g, unknown or other
  misc_feature (276)..(276): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagctgggtggagtcgtgggggagtcgttgggtcaagccgtgggacgggtccctgacgactctcctgtgcagcctntggacttcgctcgtggattgacgttcagtgacttactacatcgaccgtcgggtcccgcgaggcctaccggaagggggagggggcttaggggtacggtttgggtttaccagttactatttacgtccgttaaggttgggtgtaacttaaaccctattaactaaccgtacgctaacgtaccttcgttaggtacgggtaacgggtccgtaacgtttacccaacctacgttcccgtacccgaacggggaaacctaaaccggaccctaaaacggggtaacctaccgtaaccgttacgttaacctttacggaaacctaaagttaccggaaaccctaccccgtaggaccggaacggcccgggaaacgggacccggtaccggttaccggttaacttaacgtttacgttcggttacgaaccggtaaacgtaacccgttaaccccggtttcgacccgttttaacgggtttaactttaacccggg

SEQ ID NO: 317717 - DNA, 775 bp, Homo sapiens
  misc_feature: GZ8MTXP01EKOA1.10.79.H02.1.454.CMB.2.raw
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggacgggtccctgagactctcctgtgcagcctctggattcgcctntggattgacgttcagtgactactacatgacctgggtccncgaggctccgaggggagggctgggagttgggtttccatactatttactcctaagtggtgactaccattactactacgctagtactcgtggtaggaacgggtccgtatttacccaacctacttcccgtacccggaaaggggaaccccaaaaccgggacccctaaaacgggggtaaacccttaccctaaacccgtttacggttaaacccgtttttacggaaaccctaaaaaacgtttaccggaaaacccctaacccccggttacgggaccccgggaaaccggggaacccccgggtaaacggggaaaccccggtaaacccgggggttaccccgtttaaaatttacgttttaaacccggttgggttaccgggaacccgggtaaaaccggttaaaccgtttaaaccccccgggttttcgaccccggtttttaacgggtttttaaaccttttaaccccgg

SEQ ID NO: 317718 - DNA, 712 bp, Homo sapiens
  misc_feature: GZ8MTXP01EOCTT.10.79.H02.1.454.CMB.2.raw
  modified_base (179)..(179): a, c, t, g, unknown or other
  misc_feature (179)..(179): n is a, c, g, or t
  modified_base (334)..(334): a, c, t, g, unknown or other
  misc_feature (334)..(334): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgtgctatataaaggtntcagtgtcaggtgaagctggtggagtcgtgggggaggcttggtcaagccgtgggagggtccctgagtactctcctgtgcagtcctcgtggacttcgccctgtggtattggtacgttcagtcgaactaactacactcggaccgtcgggggtccccnccgaggcccgttaccggaaggggggaagggggtccgttagggggtaggtttcgggggttttaccccaagtttaacgttattttacgtccgttaaagggttcgggttgtaaactaccaattaacgtaacctacgcaagtactcgtaggtacggacggggcctattccaacctatccgtaccgacgggaaccaaacgccaaaacggggtaactccgtaactacgtaactttacggaactaaaacgttcgaaaccctccggtacgacggacgaacccgggaagacccgaaacggttccgttaacttaacgttccgttgggacgtaaccgaagttaacccgtaacccgttcggttacccgtttaaggttttaacttaaccgg

SEQ ID NO: 317719 - DNA, 799 bp, Homo sapiens
  misc_feature: GZ8MTXP01CD9YA.10.79.H02.1.454.CMB.2.raw
  modified_base (370)..(370): a, c, t, g, unknown or other
  misc_feature (370)..(370): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctgggtggagtcgtggggggagtcgttggtacaaggcccgtgggacggggtcccctggacgtacctctcctggtcgcacggtcccttcgtgggtacttccggcccttcgtgggtattggtacgttcaggtacgactactactagtcggacccgtcgggggtacccnccgacgggtcctaccgggaggggggtaacgggggtctaggggtaggtttcggggtttacccaagttactagttttactcccgttaaagggttggttaacgaacttaacccgtagttaactaccgtaacggacaacggtacttcgtagggtacgggaacggggtccctaagttacccaacccgttatacccgtacccggaacggggaaacccaaacggacccaaaacggggtacccttactaaccgttacggttaacctttaagaaccctaaaagttaccgaaaccctcccgtaggaccggaaaccggccggaaacggttaacccgaccgggttaccttaaagtacgttaaccgttggttacgtaacccggtaacgtaaaccgttaaccccgggttcgttacccggtttaaggtttaaccgtttaacccg

SEQ ID NO: 317720 - DNA, 577 bp, Homo sapiens
  misc_feature: GZ8MTXP01C359V.10.79.H02.1.454.CMB.2.raw
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (517)..(517): a, c, t, g, unknown or other
  misc_feature (517)..(517): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctggtggagtcgtgggggagcttggtcaagccgtgggagggtccctgagactctcctgtgcagcctntggattcgcctctggattgacgttcagtnactactacatcgacccgtgggtcccnccgaggcctccggagggggaggctgggagttgggtttcatactatttacnctaagtgngtataccatatacctacgcagtactgtgtaggaggcctatcactatcacgagacaacgccaagactcactcgacttgacaagtacgactacccgtgcgacggccgaggaccacggccgttaatcgtttaacgnggttacgaacgaacgtaaccgttaacccggttcgttaccgtttggtttaactttaacccg

SEQ ID NO: 317721 - DNA, 683 bp, Homo sapiens
  misc_feature: GZ8MTXP01EDF42.10.79.H02.1.454.CMB.2.raw
  modified_base (330)..(330): a, c, t, g, unknown or other
  misc_feature (330)..(330): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcacatggagttgggctgagtcttgggttttccttgttgctattaataaaaggtgtccagtgtcaggtgaagcgtggtggagtcggtgggggaggtcttggtcaagccgtgggacggtcctgagctctctgtgcagcctcgtggacttcgcctgtggtattggtacgttcagtgactactacatcgaccgtcgggtccnccgaggcctaccggaagggggagggtcgtggggtaggttcgggtttaccattacgtattttacgtccgttaaggttggtgaactacccgtaattaactaccgtacgctaagtacttcggtgtacgggaacgggtccaagtttacccactacttcccgaccggaaacgggaaccaaaccggacccaaaaggggtaccctctaacgttacgtacgtttacgaactaaacgtaccgaaaccctcccgtaggaccgcggaacccggacggaccacgggttacgtaattacgttacgttggttacgaagtacgtaaaccttcccgggtcttaccgttaacggtttaactttaacccgg

SEQ ID NO: 317722 - DNA, 689 bp, Homo sapiens
  misc_feature: GZ8MTXP01DWUNX.10.79.H02.1.454.CMB.2.raw
  modified_base (298)..(298): a, c, t, g, unknown or other
  misc_feature (298)..(298): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggaggtccctgagactctcctgtgcagcctctggattcgcctcgtggtattgacgttcaggtnactactacatcgacccgttgggtcccgccgaggccgtccggaaggggggaacgggggtcttagggggaggtttcggggtttacccaagttaactagttttactcccgttaaagggttggtcgtaactaaccctagttaactaaccgtacgctaacgtacttcgtaggtacggaaacggggtccctaatttacccaacccgtattcccgtaacccgaacgggggaaacccaaaccgggacccaaaagggtaacccttccaacgttcgtaactttacgaactaaagtaccgaaacctaccccgtgacccggagcccgaacggacaccgggttctaagttcttacgttgttcgaacgacgtaacctacccgttgcctttaaggtttcttaaccg

SEQ ID NO: 317723 - DNA, 582 bp, Homo sapiens
  misc_feature: GZ8MTXP01CNPDC.10.79.H02.1.454.CMB.2.raw
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtggggggagcttggtcaagcctggagggtccctgagactctcctgtgcagcctntggattcgcctctggattgacgttcagtgactactacatgacctgggtccnccgaggctccgaggggagggctgggagttggttccatactatttacnccgtaagtggtgataccattactacgtacgcagactcgtgtaggacgggccattcgacctatccaccgagggaccaacgccaaaggactcactcgtacttgacaaagtcgaacctccccgtggccgaggcccgaaggaccacgggccgttaaatcgttacttggcgaacgtagtaaccgttaacccggttcgaccgtttaaggttaactttaacccg

SEQ ID NO: 317724 - DNA, 755 bp, Homo sapiens
  misc_feature: GZ8MTXP01EVPWD.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcttgggtttttccttgttgctaattaataaaaggtgtccagtgtcaggtgaagcgtggtggagtcgtgggggagcttgggtcaagccgtggacggtccctgagactctcctgtcgcacgcctcgtggacttcgcctgtggtattcgacgttcagtcgactactacagtcgaccgtcgggtcccgcgaggcctacggaggggggacgggtctggggaggttgggtttacccattactatttacgtccgttaaagggttcggtgtaactaccctaattaactaaccctacggactaacggtacttcggtaggtacgggaaacggggtcctaagtttcccaaacctagtcccgtaaccgaaacggggaacccaaaccggacccaaaacggggtaacctttccgaaacctttcggttaaacgtttcgaaacctaaaacgttacggaaacccctaccccggtggaaccccgggaaggaaccccgggaaacggacccggtaacgggttccttaaagttaacgttacggttgggttagtaacccggtaaagtaacccgttttaaccccggtcggttacccgttttaacgggtttaacctttaacccgg

SEQ ID NO: 317725 - DNA, 873 bp, Homo sapiens
  misc_feature: GZ8MTXP01B449J.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagagactcaccatggagtttgggctgagcttgggttttccttgttgctattaataaaaggtgtccagtgtcaggtgaagcgtggtggagtcgtgggggagtcgttggtcaagccgtggacgggtccctgacgctctcctgtcgcagcctcgtggtacttccgccttcgtggtattcggtacgttcagtcgacttactacatcgaccgtcgggtcccgccgagggccctaccgggaaggggggacggggtcgttggggtaggtttggggtttacccaagtttaaccttagtttttaacgtacccggtttaagggttacgggttaacgtaaactttaaacccctaaagtttaaacttaaacccgtaccggacgtaaacgtaccgtttcgttagggtacggggaaacgggggtacccttaatttaccccgaacccgtacttaccccgacccgaaacgggggaaaccccaaacccggaccccgaaaacggggtaaaccccttccggtaaaccgtttacggttaaacccgtttacggaaacctaaaaacggttcccggaaaacccctaccccggtacggacccgggaaccgggtaaccccggggaaacgggttaacccggaacccggggttacccgtttaaagttaaccgttttaccgttcggggttaccgaaccgggtaaaaccgttaaacccggtttaacccccggtttcgggttaccccgttttaacggggtttttaacctttaaccccgg

SEQ ID NO: 317726 - DNA, 705 bp, Homo sapiens
  misc_feature: GZ8MTXP01AKP5Y.10.79.H02.1.454.CMB.2.raw
  modified_base (181)..(181): a, c, t, g, unknown or other
  misc_feature (181)..(181): n is a, c, g, or t
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgttgctattataaaggtntccagtgtcaggtgaagctggtggagtcgtgggggagcttggtcaagccgtgggacgggtccctgagactctcctgtgcagcctcgtggacttccgcctcgtggtacttgacgttcagtgactactacatcgaccgtgggtcccnccgaggtcctaccggaaggggggagggcgtgggaggttcgggtttaccagttactattttacnccgttaaggtcggtntactacctatacgtactacgcaacgacctgtggtacggaacgggtccgtacttaccacctactcccgtaccgaacggggaaccaaaccgaacccgaaacggggtaaacctacctaaccgtacggttaacctttacgaacctaaacttaccggaaacctacccgtacggaccgaacggaaccggaacgggaacccggaccgggttaccgttaacgttaacgttacgttcggttacgaacggtaacgtaaaccgttaaccccggttccggttacccgtttaacgggtttaacctttaacccgg

SEQ ID NO: 317727 - DNA, 743 bp, Homo sapiens
  misc_feature: GZ8MTXP01BM2E2.10.79.H02.1.454.CMB.2.raw
  modified_base (184)..(184): a, c, t, g, unknown or other
  misc_feature (184)..(184): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtntccagtgtcaggtgaagctggtggagtcgtgggggaggcttggtcaagcctggacgggtccctgagctctctgtgcagctntggattcgctgngtattgacgttcagtcgactactacatcgaccgtcgggtcccgccgtagggcccttaccgggaaggggggaacgggggtccgtaggggtacgggtttcggggtttaccaagttaactagttttacgtcccgttaaagggttcgggtaagaactaaccctattaacgtaccgtacgctaaacggtacttcgtaggtacggaaacggggtcctaactttaccgacctagtcccgtaccgaacgggaaccaaaccgtacccgaaacggtaacttacccgaacttacggttacctttacgaactaaacgttacggaaacccctacccgttacggaccgacggaacccggaaggacccgacggggttacccgttaaagttacgtttaccgttggttacggaaccggaaacgttaaacccgttaaccccgggtttcgttacccgttttaagggttttaacctttaacccggg

SEQ ID NO: 317728 - DNA, 696 bp, Homo sapiens
  misc_feature: GZ8MTXP01B4PEN.10.79.H02.1.454.CMB.2.raw
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (630)..(630): a, c, t, g, unknown or other
  misc_feature (630)..(630): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggacgggtccctgagctctcctgtgcagcctntggattcgcctctggattgacgttcagtgactactacatgaccgtgggtcccncgaggcctccggagggggagggctgggagttcgggtttccagttactagttttaacnccgttaaaggtgggtgacttaaccctattaactaccgtaacgcaagtacttcgtaggtacggaacggggtccctaattacccgaaccctattcccgacccgaaggggaacccaaaccgccccaaaagggaaccttccgtaaccttacggtaacctttacggaaacctaaacgttaccggaaaccctacccgttacggaccgaacgggaacccggaacgggacccgaccggttaccgttaaactacgtttaccgngttacggaaccgtaagtaaaccgtttaccccggtcgttacccgtttaaggtttaactttaacccgg

SEQ ID NO: 317729 - DNA, 712 bp, Homo sapiens
  misc_feature: GZ8MTXP01CNU90.10.79.H02.1.454.CMB.2.raw
  modified_base (329)..(329): a, c, t, g, unknown or other
  misc_feature (329)..(329): n is a, c, g, or t
  modified_base (590)..(590): a, c, t, g, unknown or other
  misc_feature (590)..(590): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcgttggtcaagccgtggacgggtccctgagactctcctgtgcagcctctggattccgcctcgtggtattgacgttcagtgactactacagtcgaccgtgggtcccnccgaggcctaccggaggggggaacggggctaggggtaggttcgggtttaccaagttactattttactcccgttaaaggttggtgaacttaaccaattaactactacgacagtacccttgtggtacggaacggggtcccgtaattacccaacctacgtcccgtaaccggaagggaacccaaaccggaccccaaaagggtaaaccctaccgtaaccttacggtaaacctttcgaaactaaaacgtccgaaaaccctaccccgngaccggaacggcccggaaagggacctaaccgggccgttaaattacgttaaccgttggttaccggaacgtaacgtaaaccgttaaccccgtttcggaccctttaaggtttaactttaacccgg

SEQ ID NO: 317730 - DNA, 527 bp, Homo sapiens
  misc_feature: GZ8MTXP01BH8HN.10.79.H02.1.454.CMB.2.raw
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (473)..(473): a, c, t, g, unknown or other
  misc_feature (473)..(473): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctctggattcgcctctggattgacgttcagtnactactacatgacctgggtccncaggctcgagggaggctggagtggttcatactatttancctaagtgtgataccatatactacgcagactctgtagaagggccattcacctatccacgagggacaacgccaaggactcactgacttgacaaatcgaactccctgcgagccggagacncggcgtatattacgttgcgcgagaactacccggttgccttggttaacttaaccg

SEQ ID NO: 317731 - DNA, 604 bp, Homo sapiens
  misc_feature: GZ8MTXP01EGRRR.10.79.H02.1.454.CMB.2.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (376)..(376): a, c, t, g, unknown or other
  misc_feature (376)..(376): n is a, c, g, or t
  modified_base (583)..(583): a, c, t, g, unknown or other
  misc_feature (583)..(583): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtctagcagcaactacgttgcctaggtaaccaaanagaaacctggaccaggcctccccgggctcctcatctagtggtacatctagcagggccagtggcactacccagacgaggttcaggtggctaggttgggctagggacagtaacttcnctctcaaccatcagcagactggagtcgtagtaagttgtttagactagttagttattattgtactagtactaaagtagttgggtacggttctaccggttcgggttacgttttacgggaccggtaacgggggaacctaaagggtcgtaagggaacgttaagtaacgaaaacgtacgtggttacggttcgttacgaacacgtaatcgttnttaccttcgaacgtttccccg

SEQ ID NO: 317732 - DNA, 720 bp, Homo sapiens
  misc_feature: GZ8MTXP01EQCMK.10.79.H02.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctntggacttcgcctntggtattgacgttcagtgactactacatcgaccgtgggtcccnccgaggcctcggagggggagggctggggagttgggtttccagttactatttactccgtaagtgtgactacatatacgtacgctacgactcgtaggtaggaaacggggtccctaatttacccaacctactcccgtaccgaacggggaaacccaaaccgaccccgaaaaggggtaacccttacgtaaacgttacgtaaccttttacggaacctaaaacgttaccgaaaacccgtaccccgttcggaaccggaaccgggtaacccggaaacgggttacccggaacccggggttacccgttaaagtttaacgtttaacccggttggttacggtaaccggaaagtaaacccgttaaccccggttcgttacccgttttaacgggttttaacccttttaacccgg

SEQ ID NO: 317733 - DNA, 900 bp, Homo sapiens
  misc_feature: GZ8MTXP01DJ9TD.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagcgtggtggagtcgtgggggagcttggtcaagccgtggagggtccctgagactctcctgtcgcagcctcgtggattcggcctcgtggtattgacgttcagtcgactaactacagtcggaccccgttgggggtccccgaccgacgggtcccgttaccgggaaggggggtaacgggggcgtagggggtacggtttcgggggttttaccaagtttaacttagtttttacgtacccgttaaagggttagggttcgtaaactttacccgaaatttaacctaaacccgttaaccggtaacgtaacggtaaccctttcggttacgggttaacgggaaaaccgggggttccccttaaagttttaacccccgaaccttaaccgttaccccgtaaccccggaaacgggggaaacccaaacccgggaacccctaaaacgggggtaaaccccttaccgtaaaccggtttacggttaaaccttttacggaaacctaaaacgttaaccggtaaacccctaccccggttaggacccgggaaccgggaacccgggaaacggggttaacccgtaacccggggttacccgtttaaagttaacctttaaccggttgggtttaaccggaaccgggttaaaacggttaaaccccgttttaaccccgggttaccggttaccccggtttttaagggttttaaacccgtttttaaccccggg

SEQ ID NO: 317734 - DNA, 606 bp, Homo sapiens
  misc_feature: GZ8MTXP01CEA1O.10.79.H02.1.454.CMB.2.raw
  modified_base (324)..(324): a, c, t, g, unknown or other
  misc_feature (324)..(324): n is a, c, g, or t
  modified_base (392)..(392): a, c, t, g, unknown or other
  misc_feature (392)..(392): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggccgtggagggtccctgagactctcctgtgcagcctctggattcgcctcgtggattgacgttcagtgactactacatgaccctgggtccnccaggctccggaggggaggggctggggagttggggtttccattacgtatttactccgtaagttgggtnactaccatatactacgcagtctctggtagacgggccgtattaccacctatcctaccgagggaccaacgaccaacggaactacacctacgtacttgactaaatacgaaccaccctgacgacggccggaacggaccgaccggaccgtattacgttacgttgttacgcgaacgtaacgttaacccgttcgttaccgttcgggtttaactttaacccg

SEQ ID NO: 317735 - DNA, 541 bp, Homo sapiens
  misc_feature: GZ8MTXP01CFCCR.10.79.H02.1.454.CMB.2.raw
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (410)..(410): a, c, t, g, unknown or other
  misc_feature (410)..(410): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccnccaggctccgagggagggctggagtggtttccatactatttnctaagtgtnataccatatacacgcagactctgtgagggcattcaccatcncgaggacaacgaccaacggaactcactcgtactttgacaaatacgaacctaccctgacgagccggaggacacggcgtatattacgttgttcgaacgagtaactaacccgtcgaccttggttaacttaaccg

SEQ ID NO: 317736 - DNA, 623 bp, Homo sapiens
  misc_feature: GZ8MTXP01CUGQC.10.79.H02.1.454.CMB.2.raw
  modified_base (330)..(330): a, c, t, g, unknown or other
  misc_feature (330)..(330): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctgggtggagtcgtgggggaggcgttggtcaaggcctgggaggtccctgacgactctcctgtgcagcctcgtggattcgcctcgtggtattgacgttcagtgactactacatgacctggggtcccnccgaggcctccggagggggagggctggggnggttgggtttccagttactattttacgcccgttaaaggttgggtnacttacccattatacctacgcagactcgtggtacggacgggccgtacttaccaccactcctacccgagggaaccaaccgaccaaacggacctacactacgtactttgactaatacgaacctaccctgcgacgccgacggaccgaccggccgtatacttacgttcgttcgaacgtacgtaacgttacccggttcgttccgttcggtttaactttaaccg

SEQ ID NO: 317737 - DNA, 574 bp, Homo sapiens
  misc_feature: GZ8MTXP01B7U1Z.10.79.H02.1.454.CMB.2.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggacggtccctgagactctctgtgcagcctctggattcgcctctggattgacgttcagtgactactacatgacctgggtccncgaggcctacgaggggagggctgggagtggttccatactatttancctaagtgtgataccatacactacgcagactctggtgaagggccgtattaccactatcctacgagggaacaacgaccaaaggaactcactgtactttgactaaagtacgaacctacccgtgcgaggcccgaaggaccacgggccgtaatacttacgttggcgaacgagtaacgttaacccgtcgttccgttaacggtttaacttaacccg

SEQ ID NO: 317738 - DNA, 600 bp, Homo sapiens
  misc_feature: GZ8MTXP01BBW08.10.79.H02.1.454.CMB.2.raw
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttggctgagctgggttttccttgttgctattataaaggtgtccagtgtcaggtgaagctggtggagtcgtgggggagcttggtcaagcctggagggtccctgagactctcctgtcgcagcctctggattcgctctggtattgacgttcagtgactactacatgaccgtgggtccncaggcctcgagggggacgggctgggagtggtttccatactatttnccgtaagtgtgataccattactactacgcagactctggtagtacggggcctattaccaacctatccgtaccgaaggggaccaaaccgacccaaaggaacctcgtaactcgtaactttgaactaaagtcgaaaccctacccgtgacgacggccggacggaccgacgggcctaaagttcttacgttggttacgaacggagtaacctttacccgtcgttccgtttaaggttaactttccg

SEQ ID NO: 317739 - DNA, 720 bp, Homo sapiens
  misc_feature: GZ8MTXP01DEWRP.10.79.H02.1.454.CMB.2.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (328)..(328): a, c, t, g, unknown or other
  misc_feature (328)..(328): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagcgtggtggagtcgtgggggaggtcttggtcaagccgtggacgggtccctgagcctctcctgtgcagcctntggnttcgctctggattgacgttcagtcgactactacagtcgaccgtgggtcccncgacggccgtaccggagggggaacgggtcgtagggagttcggggtttaccaattacgtatttttaacgtcccgttaaagggttggttcgaacttaaacccctaattaacgttaaccgttaacggacctaacgtacccttgtacggttagggaaaccggggtaccgtaacttacccaacctacgttacccgaccggaaacggggaacctaaacccgacccgaaaagggtaacccttcgaaaccgtttggttaacctttacgaactaaacacgtaaaccctaccccgtgaccggacgaacccggaaggaccgaccgggttcgttaattacgttacgttgacgtaaccgaagtaacctttacccggtcttacgtttaacggttaactttaaccgg

SEQ ID NO: 317740 - DNA, 688 bp, Homo sapiens
  misc_feature: GZ8MTXP01DIEZA.10.79.H02.1.454.CMB.2.raw
  modified_base (266)..(266): a, c, t, g, unknown or other
  misc_feature (266)..(266): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggaggtcgttggtcaagccgtggacgggtccctgagactctcctgtncagcctcgtggacttccgcctcgtggtattggacgttcagtgaccttactacacttcggaccccgttgggggtccccgccgagggtccctaccggaaggggggacggggtcgtaggggtaggtttgggtttacccagttaactagtttttacnccgttaagggtggttgtaactaacccgtaattaactacctacgtcaagtccttgtggtacggaacgggtcctacttaccacctagtccaccgaacgggacaaaccgtccaaagtaacctcgtaactcgtaactttgaacctaaagtaccgaacctacccggtgacgggacgcccggtaaggacctaccgggccttaatacgtttaacgttgttacgaacgtaaactaaccgttaaccccggtcgttaccgttaaggtttaacttaaccg

SEQ ID NO: 317741 - DNA, 629 bp, Homo sapiens
  misc_feature: GZ8MTXP01DZ8XD.10.79.H02.1.454.CMB.2.raw
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
  modified_base (386)..(386): a, c, t, g, unknown or other
  misc_feature (386)..(386): n is a, c, g, or t
  modified_base (580)..(580): a, c, t, g, unknown or other
  misc_feature (580)..(580): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttgggctgagctgggttttccttgttgctattataaaggtgtccagtgtcaggtgaagctggtggagtcgtgggggagcttggtcaagcctggagggtcctgagactctcctgtgcagcctntggacttcgctctggtatgacgttcagtgactactacatcggacctgggtccnccgaggcctacggagggggagggtctgggagttcggtttacatactatttactccgtaaaggttgggtntaactacccgtaaattacttacctacgctagtaccttgtgggtacggaacggggtcctaattccaacctatccgtaccgaacggggacaaaccggtcccaaagggtaacctcaaccgtgtaacctttgaacctaaagttcgaaaccctcccgtggccgacgaaccggaggaccaccgggttctaatacttacgngttacgaagtataacgttacccggttcacgttcggtttaacttaaccgg

SEQ ID NO: 317742 - DNA, 736 bp, Homo sapiens
  misc_feature: GZ8MTXP01BWVKM.10.79.H02.1.454.CMB.2.raw
  modified_base (186)..(186): a, c, t, g, unknown or other
  misc_feature (186)..(186): n is a, c, g, or t
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtntccagtgtcaggtgaagctggtggagtcgtgggggagcttggtcaagccgtggacgggtccctgagctctcctgtgcagcctcgtggcttcgcctgtggtattgacgttcagtcgactactacatcggaccgtcgggtccnccgaggcctaccggaaggggaggggtctgggagtttcggggtttacaagttactagttttacgtcccgttaaaggtggtaagtacttaaccctaagttaactaaccgttaacgacctaagtaccttcgttacggtaggaacggggtcccgtaatttacccaacctataccccgtacccggaaaggggaaaccccaaacggaacccctaaacggggaaaccttacctaaccgtacggttaacctttgaaaccgtaaattaccggaaccctaaccccggtggacccggacgaacccgggaacggaccgtaacccgggttacggttaacttacgttaaccgttggttacgaaccgtaaacgtaaccgttaaccccggttcgttacccgtttaaggtttaacctttaacccgg

SEQ ID NO: 317743 - DNA, 564 bp, Homo sapiens
  misc_feature: GZ8MTXP01D5GU7.10.79.H02.1.454.CMB.2.raw
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgagctggtggagtcgtgggggaggcttggtcaagcctggagggtccctgagactctcctgtgcagcctctggattcgcctctggattgacgttcagtgactactacatgaccctggggtccnccgaggctcgaggggaggctggagtgggttccagtacatttanctaagtggtnataccatatacacgcagtactntggtagacggctattcacatcacgaggacaacgaccaaggaactcaactgtacctttgacctaaatcgaaaccctccgtcgcggagcccggaagaccgaacgggccttaatnttacgttgttagaacgtaagtaacgttaacccgtcgccgttaaggtttaacttaaccg

SEQ ID NO: 317744 - DNA, 654 bp, Homo sapiens
  misc_feature: GZ8MTXP01DVM0K.10.79.H02.1.454.CMB.2.raw
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggaggcttggtcaagccgtggacgggtccctgacgactctcctgtncagcctgtggacttcgcctcgtggtattgacgttcagtgactactacntcgaccgtgggtccncgaggcctcggagggggagggctggagttgggttacattactatttactccgtaagtcggtgactacctaattactaccgtacgcacgtactcgtaggtaggaacgggtcctaattaccaacctactccgtaccgaagggaaccaaaccgtaccaaacgggtaacctacaacgttacgtaactttcgaaacctaaagttacgaaaccctcccgtagaccggaacggaacccggaacggaccgtaccgggttaccgttaataacgtttacgttgacgtaacgaactaaccgttaacccgtcgttaccgtttggtttaaccttaaccg

SEQ ID NO: 317745 - DNA, 613 bp, Homo sapiens
  misc_feature: GZ8MTXP01AUJOA.10.79.H02.1.454.CMB.2.raw
  modified_base (324)..(324): a, c, t, g, unknown or other
  misc_feature (324)..(324): n is a, c, g, or t
  modified_base (393)..(393): a, c, t, g, unknown or other
  misc_feature (393)..(393): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtggacgggtccctgacgactctcctgtgcagcctctggacttcgcctctggattgacgttcagtcactactacatcgacctgggtcccncgaggcctacggagggggagggctggggagttggggtttaccattactatttactccgtaaggtgggtnataacccattactacgtacgcaagacttcgtggtaggaacggggtcctagttaccacctatcctaccggagggaaccaacgacccaaaggaacctcactcgtactttcgactaaatcgaaacctcccgtgaccgacgccggaaggccaacgggttcctaattacttacgttgacgaacgaacgtaacctaccccggttgaccgttaaggtttcttaaccg

SEQ ID NO: 317746 - DNA, 694 bp, Homo sapiens
  misc_feature: GZ8MTXP01A1QS5.10.79.H02.1.454.CMB.2.raw
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (626)..(626): a, c, t, g, unknown or other
  misc_feature (626)..(626): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggagtcttggtcaagccgtggacgggtccctgacgacctctcctggtcgcacgtcctcgtggtacttccggcctcgtggtattcgacgttcagtcgactactacatcgaccgtcgggtcccgccaggcctcggaagggggaggggcgtgggaggttcgggtttacattacttatttacgtccgtaaggttgggtnactaaccattactactacgnacgtactgtaggtaggaacgggcctaattaccacctacgtccgaccggaacggaaccaacggaccaaacggggtacctacgacgttacgttaaccgtttagaacctaaacgtaccggaacctaccccgtaggaccggaacggtaacccggaaggttacccggaccgggttcctaaagttacgttaaccgngggttaccgaacgggtaacgtaaccgttaaccccggttcggttacctttgggtttaaccctttaaccg

SEQ ID NO: 317747 - DNA, 760 bp, Homo sapiens
  misc_feature: GZ8MTXP01BD0QN.10.79.H02.1.454.CMB.2.raw
  modified_base (264)..(264): a, c, t, g, unknown or other
  misc_feature (264)..(264): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctggtggagtcgtgggggaggcttggtcaagccgtggagggtccctgagactctcctgtncagcctctggattccgcctcgtggattgacgttcagtcgactactacagtcgacccgtcggggtcccgccgacggccgtccggagggggaagggggtcgtggggaggttcggggtttaccaattacgtagttttactcccgttaagggttcggtgtaacttaacccgtaattaacgttaacccgtaaccggacaacggtaacccttcgttaggtacgggtaaaccggggccgtaatttacccgaaccctacgtcccgtacccggaacggggaaccaaacccggcccaaaggggtaaccctcgtaaaccgttcggtaactttacggaacctaaagttaccgaaacccgtaccccgtagggaccgaaccggaacccgggaacgggaacccgtacgggttaccgttaacgtaacgtttaccgttggttacgggtaacgtaacggtaacccgtttaaccccggtccgttacccgtttgggttttaacctttaaccccggg

SEQ ID NO: 317748 - DNA, 661 bp, Homo sapiens
  misc_feature: GZ8MTXP01A5CYW.10.79.H02.1.454.CMB.2.raw
  modified_base (577)..(577): a, c, t, g, unknown or other
  misc_feature (577)..(577): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttgggctgagctgggtttcctgttgctattataaaggtgtccagtgtcaggtgaagctggtggagtcgtgggggagcttggtcaaggccctgggacgggtccctgagtactctcctgtgcagccctgtggtacttccgccttcgtggtattggtaccgttcagtcgtaacttactacgatcggacccgtggggtccccaccgtagggtcccttaccgggaaggggggtacggggtcgttagggaggttcgggtttaccacggttactatttacgtccgtaaaggtggtaatactaacccgtatacgtaactacggactacggacttcgtagtacgggacgggtccctattaccacctaatcccgaacgacgggaaccaaccgtacgaaacgtctaccacgtcgtaacttgaaacttaaagcgaaaccctcccggngaccgagccgtagaccacggttctatacgttcgttggacaacgtacgtaacccgttaccgtcgttaccgtttcgttaaccgtcg

SEQ ID NO: 317749 - DNA, 739 bp, Homo sapiens
  misc_feature: GZ8MTXP01BJQV6.10.79.H02.1.454.CMB.2.raw
  modified_base (341)..(341): a, c, t, g, unknown or other
  misc_feature (341)..(341): n is a, c, g, or t
  modified_base (669)..(669): a, c, t, g, unknown or other
  misc_feature (669)..(669): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagagactcaccatggagtttgggctgagtcttgggttttccttgttgctattataaaaggtgtccagtgtcaggtgaagctggtggagtcgtgggggagtcttggcaagccgtggacggtccctgagactctcctgtcgcagcctcgtggacttccgccttctggtattgaaccgtttcagtcgtaactaactacgatcggacccgtggggtccccnccgaggtcccgtccggaagggggtacgggcgtgggtagttcgggttacccattactatttactccgtaagttggtcgtaactacccgtaattactacctacggactacgtactcgtaggtacggaacggggcctattacccgacctagtaccgtaccgaaacgggaacctaaaccggacccaaaggggtaccttaccgtaaccgttaggtaacctttacggaaaccttaaaagttacccggaaaccctaccccggtaggaaccccggtaaggaaccccgggaaacggttacccggtaccggttaccgttaaacgtttacgtttaccgnggttacgaaccggtaacgtaaccgtttaaccccgtttcggaccgttttcggtttaacttttaaccccggg

SEQ ID NO: 317750 - DNA, 530 bp, Homo sapiens
  misc_feature: GZ8MTXP02ISS2P.10.79.H02.1.454.CMB.2.raw
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (495)..(495): a, c, t, g, unknown or other
  misc_feature (495)..(495): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggtccgccaggctccagggagggctggagtggtttccatacntttatctagtgtgataccatatactacgcagactntgtagaacgggctattcactatcacgaggacaacgacaaagactcactgacttgacaaatcgaacaccacgacgacgacgacgacgacgacgtactactactagtgngacgaacgtaccgtacgtacgtacgttacgttacg

SEQ ID NO: 317751 - DNA, 553 bp, Homo sapiens
  misc_feature: GZ8MTXP02IXYO2.10.79.H02.1.454.CMB.2.raw
  modified_base (275)..(275): a, c, t, g, unknown or other
  misc_feature (275)..(275): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
tcagcatagtagtgcacgaccggtgctcgatttagtgtcacacgaagggaaagggagctctgggagaagagccccagccccagaattcccaggagttccattcggtgatcagcactgaacacagaggactcaccatggagtttgggctgagctgggttttccttgttgctattataaaggtgtccagtgtcaggtgaagctggtggagtctgggggaggcttggtcaagccgtggagggtccctgagactctcctgtgcagcctctgatcgctcnggatgacgttcagtgactactacatcgaccgtcggtccgccaggctccgagggagggctggagttggttcatactattactctaggtgtgataccatatactacgcagtactctgtaggaacgggccattccacactctaccgagggacaaccgccaaagaacctnaccagtacttcgaanaaactacgaaccnccgtgacgacgaccggagaccgacggacgttatacttacgtgacgaacgaacgtaacttacccgtcgcttaggtttacttaccg

SEQ ID NO: 317752 - DNA, 541 bp, Homo sapiens
  misc_feature: GZ8MTXP02IRV7Y.10.79.H02.1.454.CMB.2.raw
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagcttggtcaagcctgggagggtccctgagactctcctgtgcagcctctggattcgcctcgtggattgacgttcagtgactactacatcgaccgtgggtccncaggcctcgagggagggctggagtggttccatacatttatctagtgtnatacatatactagcagactctgtagaacgggcattcaccatcncgaggacaacgccaaagactcactgacttgactaaatcgaacnccctgacgacgccgaggaccacggaccgtaatacttactgtacgaacgaagtaaccttacccgtcacccgttaggtttactttaccg

SEQ ID NO: 317753 - DNA, 519 bp, Homo sapiens
  misc_feature: GZ8MTXP02GSW3L.10.79.H02.1.454.CMB.2.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (495)..(495): a, c, t, g, unknown or other
  misc_feature (495)..(495): n is a, c, g, or t
tcagcatagtagtgcacgaccggtgctcgatttagtgtcacacgaagggaaaggggctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccatggcatccccagacaggttcagtggcagtgggtctggggacagacttcnctctcaccatcagcagactggagtctgaagtattttgctagttgtattattgtcagtacaattagtgggttaggtcaccgttgggtacttttggaccgtaggggaccaagcgtaggagatacgaaacgactagngctgcaccatctgtctcacttccc

SEQ ID NO: 317754 - DNA, 532 bp, Homo sapiens
  misc_feature: GZ8MTXP02F2TL3.10.79.H02.1.454.CMB.2.raw
  modified_base (316)..(316): a, c, t, g, unknown or other
  misc_feature (316)..(316): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtctgggggagcttggtcaagcctggagggtccctgagactctcctgtgcagcctctggattcgcctctggattgacgttcagtgactactacatgacctgggtccnccaggcctccgaggggaagggctgggagtgggttccatacatttatcctagtggtgataccatatactacgcagactctgtgaagggccattcaccatctccagggacaacgccaaagactcactgacttcgacaaatgaaacnccctgcgagccgaggacacggcctatacttacngtgaacgagaactacccgtcnccgttggttactttaccg

SEQ ID NO: 317755 - DNA, 546 bp, Homo sapiens
  misc_feature: GZ8MTXP02JAKD4.10.79.H02.1.454.CMB.2.raw
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctggagggtccctgagactctcctgtgcagcctctggattcgcctctggattgacgttcagtgactactacatcgacctgggtcccnccaggctccgaggggagggctgggagtgggttcatactatttatcctagtgtgataccatatactacgcagactctgtgaagggccattcaccatcncaggacacgccaagactcactgacttgacaatcgaaaccncccgtgacgacgccggagacgacggcctatacttacgtgtacgaacgaagtaaccgttacccgtcgtaccgttacggtttactttaccg

SEQ ID NO: 317756 - DNA, 507 bp, Homo sapiens
  misc_feature: GZ8MTXP02HXQV0.10.79.H02.1.454.CMB.2.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcaggccactggcatcccagacaggttcagtggcagtgggtctggggacngacttcnctctcaccatcagcagactggagtctgaagtattttgctagtgtattattgtcagcaattatggtaggtcacgtgggtactttggcgtaggggaccaagcgtggagatacaaacgaactgtacgctagcaccatctgtcttcactcc

SEQ ID NO: 317757 - DNA, 469 bp, Homo sapiens
  misc_feature: GZ8MTXP02FQG2J.10.79.H02.1.454.CMB.2.raw
  modified_base (459)..(469): a, c, t, g, unknown or other
  misc_feature (459)..(469): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgccttggttattaccttgacacgttggggccaggggaacccctggtcaccgtctcctcacgcctccaccaacgggccccatccggtccttcccccgtggccgcccctgcctccaggacgccaccctccgagacgcacaggccggccctggggcctgccctgggtacaaacgggaccttccttccccaacttacctatcgctggacgcgggctggacaagggcgacagagnnnnnnnnnnn

SEQ ID NO: 317758 - DNA, 540 bp, Homo sapiens
  misc_feature: GZ8MTXP02J2WYL.10.79.H02.1.454.CMB.2.raw
  modified_base (200)..(200): a, c, t, g, unknown or other
  misc_feature (200)..(200): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccagctctcctgcagggccagtcagagtcttagcagcaactacgttgcctggtaccaacagaaacctggccaggctcccgggctcctcatctatggtacatctagcagggccagtggcatcccagacaggttcaggtcgcaggtggggtctggggacaggtcttcgacttcncaccatccagcagactgagtctgagtntttgcagttgtattattgtcagtcaatagtggtagtctacgtgggtactttggccgtagggggaccaaggtcgtagggagtaactacgaaaacgacgtaggtacggcgtacggacacctacgtcttacgttcctttacg

SEQ ID NO: 317759 - DNA, 494 bp, Homo sapiens
  misc_feature: GZ8MTXP02IUEX8.10.79.H02.1.454.CMB.2.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgtgcctggtaccaacagaaacctggccaggctcccgggctcctcatctatggtacatctagcaggcactggcatcccagacaggtcagtcggcagtggtctgggacagcttcactctcaccatcagcagactggagtctgaagtattttgctagtgtattattgtcagcaatagtgtagtcacgtgggtactttggccagtggacctagcgtggagatcaaaacgtactagtgctgacaccatctgttc

SEQ ID NO: 317760 - DNA, 534 bp, Homo sapiens
  misc_feature: GZ8MTXP02HF3TR.10.79.H02.1.454.CMB.2.raw
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctgggagggtccctgagactctcctgtgcagcctctggattcgcctntggattgacgttcagtgactactacatcgacctgggtccncaggcctccgaggggagggctggagtggttccatacatttanctagtgtgatacatatactacgcagactctgtagaagggccattcaccatctccgaggacaacgccaaagactcactgtacttgacaaatcgaacaccctgacgagaccgaggaccacggccgtaatactactgtgaacgagaactacccgttcgccgttaggttacttaccg

SEQ ID NO: 317761 - DNA, 779 bp, Homo sapiens
  misc_feature: GZ8MTXP02I641D.10.79.H02.1.454.CMB.2.raw
tcagcatagtagtgcacgaccggtgctcgatttagtgtcacacgaagggaaagggagctctgggagaagagccccagccccagaattcccaggagtttccattcggtgatcagcactgaacacagaggactcaccatggagtttgggctgagctgggttttccttgttgctattataaaaggtgtccagtgtcaggtaagacgtgtggtaggtcgtggggtaggggcgttggttcgtaacgaccgtcggtaggggtacccgtccgtaggaacgtcctccctcgtggtcgacgccgtccttcgtcgacttcgtcctcctggtagttgtacgttcctagtagtactaacctaactactagtaccgtccggttccggtcccacggacgtccacggggaaagggggacggtcggtaagggttcggggtttccggttactacgtaactttaagtttaccctacggtttagggtcgggtaataacctaactaattaaccgttaacgaccgacgaacgttcctttggtaggtaaacgggggacccggtacttaacttaccccaaacttcgtccccgaaacgggggaacgaaaccggaaccccaaagaaaccgtttaccacctacgttacgtttaacgtcgaaaatacggtaaaccaaccccttcgcggaacgacccgggaggaaaccgaccgggtaccccggttaaactttattaccttggttgaacggtacggtaaaaacttaaccccgtttcccgggtcctcggggttttaaacttttaacccg

SEQ ID NO: 317762 - DNA, 524 bp, Homo sapiens
  misc_feature: GZ8MTXP02HHHOZ.10.79.H02.1.454.CMB.2.raw
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttgggtcaagcctgggagggtccctgagactctcctgtgcagcctctggattcgcctctggattgacgttcagtgactactacatgacctgggtccncaggctccgagggagggctggagtggttccagtacatttanctagtgtgatacatatactacgcagactctgtgaagggccatcacatcacaggacaacgccaagactcactgacttgactaatcgaacnccctgcgaggccgaggacacggccgtatactacngtagaacgagaaactacccgttgaccttaggttacttacg

SEQ ID NO: 317763 - DNA, 785 bp, Homo sapiens
  misc_feature: GZ8MTXP02G7YVB.10.79.H02.1.454.CMB.2.raw
  modified_base (288)..(288): a, c, t, g, unknown or other
  misc_feature (288)..(288): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctattataaaggtgtcagtgtcaggtgaagctggtggagtcgtgggggagcttggtcaagcctggagggtccctgagactctcctgtgcagcctctggattcgcctctggattgacgttnagtgactactacatcgaccgtgggtccgcgaggcctaccggaaggggaaggggcgtaggggtaggtttggggtttaccaagttactattttacgttaccgttaggttgggtagtaacttaaacctaaattaacgttaaccgtaaccgacaaacgtaccttcgttaggtaacgggaaacgggggtacccgtaagtttacccaaaccctaacttacccgtacccggaaacgggggaaaccccaaaaacccggaccccgtaaaaaggtaaacccttaccgaaaccgttacggttaaccgttttacggaaacctaaaaagtaaacgtaaaacccgtaaaccccgtaccggaccggaaccggaacccggaaccgggaaaccggaaacccgggtaacccggttaaacgttaacgtttaaccgttacggtacggtaacggtaaacggtaaaaccgttaaaccccggttaacccggtacccgtttaccggtttaacgtttaaccg

SEQ ID NO: 317764 - DNA, 537 bp, Homo sapiens
  misc_feature: GZ8MTXP02I3F7S.10.79.H02.1.454.CMB.2.raw
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggttttcctgtgctattataaaggtgtccagtgtcaggtgaagctggtggagtcgtgggggagcttggtcaagcctggaggtccctgagctctcctgtgcagcctntggattcgctcgtggattgacgttcagtgactactacatcgaccgtgggtccnccaggcctccgagggagggctggagtggttcatcatttcnctagtgtnactacatactactacgcagactcgtgtagaacggggcctattaccaccattccacccgagggaccaaacgcaaagactcactgacttgacaatcgaactcccagcgacgaccgtagaccacgggactatactactgtagcgagtaactacccgtcgaccgttagttactttacg

SEQ ID NO: 317765 - DNA, 561 bp, Homo sapiens
  misc_feature: GZ8MTXP02JZMT9.10.79.H02.1.454.CMB.2.raw
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgtgctattataaaggtgtccagtgtcaggtgaagctggtggagtcgtgggggagcttggtcaagcctgggagggtccctgagactctcctgtgcagcctctggacttcgccttgtggattgacgttcagtgactactanatgaccgtgggtcccncgaggcctaccggaggggacggggctggggagttcgggttacatactatttanctagtgtgataccatatactacgcagactcgtgtggaacgggcctattcacctatcctaccgaggacaaccgcaaagactcatgacttgacaatcgaaccnccgtgacgacgaccggaggaccgacggtacctatacttacgngtagaacgaacgtaacgtacccgtcgccgttaggttactttaccg

SEQ ID NO: 317766 - DNA, 537 bp, Homo sapiens
  misc_feature: GZ8MTXP02JNXXV.10.79.H02.1.454.CMB.2.raw
  modified_base (453)..(453): a, c, t, g, unknown or other
  misc_feature (453)..(453): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtctgggggaggcttgggtcaagcctggagggtccctgagactctcctgtgcagcctctggattcgcctctggattgacgttcagtgactactacatgacctggtccgccaggctcagggagggctggagtggttccatacatttatctagtggtgatacatatactacgcagactctgtgaagggccattcaccatctccagggacaacgccaaagactcaactgactttgacaaatcgaacnccctagcgacgccgaggaccacggccgtaatacttacgtgtacgaacgagaacttacggacccgttacgtccgttagtttaacc

SEQ ID NO: 317767 - DNA, 530 bp, Homo sapiens
  misc_feature: GZ8MTXP02JIL7C.10.79.H02.1.454.CMB.2.raw
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgcaggctccgagggagggctggagtggttccatacatttatctagtgtgatacatatactacgcagactctgtgaagggcattcacatctccaggacagccaaagactcactgacttgacaaatcgaacaccctgacgngaccgaggtaccacgggccgtactattacngtagcgtagaacttaccccggtnaccttaggtttactttacccg

SEQ ID NO: 317768 - DNA, 524 bp, Homo sapiens
  misc_feature: GZ8MTXP02IJNC2.10.79.H02.1.454.CMB.2.raw
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (487)..(487): a, c, t, g, unknown or other
  misc_feature (487)..(487): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttgggtcaagcctgggagggtccctgagactctcctgtgcagcctctggattcgcctnggattgacgttcagtgactacacatgacctgggtccnccaggctcgagggagggctggagtggttccatacatttanctagngtgataccatatactacgctagactcngtgaagggccattcacatcaccaggacaacgccaaagaactcactgacttgacaaatcgaacaccctgccgagccgaggcacgccgtatattacngtgaacgagaactacccgttgccctggtttattaccg

SEQ ID NO: 317769 - DNA, 555 bp, Homo sapiens
  misc_feature: GZ8MTXP02HWHXP.10.79.H02.1.454.CMB.2.raw
  modified_base (316)..(316): a, c, t, g, unknown or other
  misc_feature (316)..(316): n is a, c, g, or t
  modified_base (506)..(506): a, c, t, g, unknown or other
  misc_feature (506)..(506): n is a, c, g, or t
  modified_base (534)..(534): a, c, t, g, unknown or other
  misc_feature (534)..(534): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctctggatcgcctctggattgacgttcagtgactactacatcgacctggtccnccgaggctcgaggggagggctggagtggttcatacatttactctagtgtgataccatactactacgcagactcgtgtagaacgggccgtattcacctatctaccgaggacaacgccaaagactcactgacctttgacaaatcgaaacaccctagcgacgccgaaggaccgacggaccgttaatacttacnggtagaacgaagaaacttaaccccggtnacccgttggtttaacttaccg

SEQ ID NO: 317770 - DNA, 571 bp, Homo sapiens
  misc_feature: GZ8MTXP02H1MAA.10.79.H02.1.454.CMB.2.raw
  modified_base (365)..(365): a, c, t, g, unknown or other
  misc_feature (365)..(365): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggcctcccgggctcctcatctatggtacatctagcaggccatggcatcccagacaggtcagtcggcagtggtctgggacagcttcactcncaccatcagcagactggagtctagtaagtatttgctagtgttattattgtactagtactaatagtggtaggtacgtacgttggggtacgttttcgggaccgtaacgggggtacccgtaaaggccggttagggagtaacgtaccgaaaacgtaaccgttaggtcggggtaactcggaccaccgtaacgtaccttacgttcgtttacc

SEQ ID NO: 317771 - DNA, 561 bp, Homo sapiens
  misc_feature: GZ8MTXP02I5Q0O.10.79.H02.1.454.CMB.2.raw
  modified_base (200)..(200): a, c, t, g, unknown or other
  misc_feature (200)..(200): n is a, c, g, or t
  modified_base (330)..(330): a, c, t, g, unknown or other
  misc_feature (330)..(330): n is a, c, g, or t
  modified_base (392)..(392): a, c, t, g, unknown or other
  misc_feature (392)..(392): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccatggcatcccagacnggttcagtggcagtggtctgggacagcttcactctcacatcagcagactggagtctgaagtntttgctagtgtatttattgtcagtactaatagttaggtacggtctaccgttgggttacgttttgggaccgtacgggggtaccgaaaggtccgttagggacgtaagtaccgaaaacgtaaccgtaggtacggtaactggacacccgtattaccgttcgttacctttaccg

SEQ ID NO: 317772 - DNA, 541 bp, Homo sapiens
  misc_feature: GZ8MTXP02HJCQT.10.79.H02.1.454.CMB.2.raw
  modified_base (318)..(318): a, c, t, g, unknown or other
  misc_feature (318)..(318): n is a, c, g, or t
  modified_base (367)..(367): a, c, t, g, unknown or other
  misc_feature (367)..(367): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctggtccncaggctcgagggagggctggagtggttccagtacatttatctagtggtnatacatatactacgcagactctgtgaggcgattcaccatctccaggacaacgaccaagaactcactgactttgactaaatcgaaccacctagacgacgccgaggaccacggaccgtatacttacgtgtcgaacgaacgaacgtaacccgttcgccgttacggtttactttaccg

SEQ ID NO: 317773 - DNA, 549 bp, Homo sapiens
  misc_feature: GZ8MTXP02IWAR6.10.79.H02.1.454.CMB.2.raw
  modified_base (320)..(320): a, c, t, g, unknown or other
  misc_feature (320)..(320): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatcgacctgggtccncaggcctcgagggtagggctggagtggttccatactatttatctagtgtgataccatatactacgcagactcngtgaagggccattcacatcncgaggacaacgcaaagactnactgacttgacaaatcgaaaccnccctagacgacgccgaggaccaccggaccgtaatacttactgtacgcgtaacgtaaactaaccccggttgaccctttaggtttaactttaccg

SEQ ID NO: 317774 - DNA, 535 bp, Homo sapiens
  misc_feature: GZ8MTXP02JXDLU.10.79.H02.1.454.CMB.2.raw
  modified_base (441)..(441): a, c, t, g, unknown or other
  misc_feature (441)..(441): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtccagtgtcaggtgaagctggtggagtctgggggaggcttggtcaagcctggagggtccctgagactctcctgtgcagcctctggatcgcctctggattgacgttcagtgatactacatgacctcggtccgccacggcgtccgacgggaaggggcgtggaggtgggttccgtatacattatctagtgtgatacatatactacgcagactctgtgaggcggattcacatctccagacaacgacaacacacactatacttanacatacacaccacgacgacgacgacgacgacggacgtactactactacgtacgaacgtacgtaacgtaccgtacgtacgttacgttacgttacg

SEQ ID NO: 317775 - DNA, 585 bp, Homo sapiens
  misc_feature: GZ8MTXP02FR5FO.10.79.H02.1.454.CMB.2.raw
  modified_base (319)..(319): a, c, t, g, unknown or other
  misc_feature (319)..(319): n is a, c, g, or t
  modified_base (479)..(479): a, c, t, g, unknown or other
  misc_feature (479)..(479): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatggacctgggtccnccaggcctccgaggggacgggctgggagttggttccattatatttatcgtagtggtgataccatatactacgcagtactgtgtgaaggcccgattcacctatcctaccgaagggacaacgacccaaagacctcactcgtactttgactaaatgaaacccnccgtagcgacgccggaacggaccgtacggtacttaacttacgttacgtaggtacgaacgtaacgtaaaccgttacccggttcgtaccgttacggtttacctttacg

SEQ ID NO: 317776 - DNA, 581 bp, Homo sapiens
  misc_feature: GZ8MTXP02I456R.10.79.H02.1.454.CMB.2.raw
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggagggtccctgagactctcctgtgcagcctctggattcgcctctggattgacgttcagtgactactacatgacctgggtcccnccaggctccgaggggagggctggagtggttccatactatttatcgtagtgtgataccatactactacgcagactctgtgaagggcgattcaccatctaccgaggacaacgacaaagactcactgacttgactaaatcgaaccaccgtagaccgacgaccggacgggaccaccgggtaccgttaaattacttaaccgtggtacgaaccggtaagtaaaccgttaaccccggttcgtacccgtttaggtttaactttacccg

SEQ ID NO: 317777 - DNA, 531 bp, Homo sapiens
  misc_feature: GZ8MTXP02IWIPE.10.79.H02.1.454.CMB.2.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (513)..(513): a, c, t, g, unknown or other
  misc_feature (513)..(513): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtctgggggaggcttggtcaagcctggagggtccctgagactctcctgtgcagcctctggattcgcctctggattgacgttcagtgactacacatgacctgggtccnccaggcctcgagggagggctggagtggtttccatactatttatctagtgtgataccatatactacgcagactctgtagaggggcaatcaccatcnccgagggacaacgccaaagaactcactgactttgacaaatgaaacnccctgcgagccgagacacgggctaatactactgtcgaagacgaactacccgttnaccttggttactttaccg

SEQ ID NO: 317778 - DNA, 605 bp, Homo sapiens
  misc_feature: GZ8MTXP02GLCWA.10.79.H02.1.454.CMB.2.raw
  modified_base (320)..(320): a, c, t, g, unknown or other
  misc_feature (320)..(320): n is a, c, g, or t
  modified_base (378)..(378): a, c, t, g, unknown or other
  misc_feature (378)..(378): n is a, c, g, or t
  modified_base (505)..(505): a, c, t, g, unknown or other
  misc_feature (505)..(505): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggaggtcctgagctctcctgtgcagcctctggacttcgctcgtggattgacgttcagtcgactactacagtcgaccgtgggtcccnccgaggcctccgaggggtaacggggctaggggagttgggtttaccagtactatttacnccgtagtggtgactacatatactacgcagactcgtgtagaagggcctattacaccctatccgtaccgagggaccaaacggccaaagacctacacttacggtactttagacaaatcgaaaacctcccnggacgacgaccggaggaccaccggtaccgtatacgttacctggtacgaaccgtaagtaaaccgttaccccggttcgacctttaggttacctttaacccgg

SEQ ID NO: 317779 - DNA, 534 bp, Homo sapiens
  misc_feature: GZ8MTXP02FU5XU.10.79.H02.1.454.CMB.2.raw
  modified_base (196)..(196): a, c, t, g, unknown or other
  misc_feature (196)..(196): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcacacgaagggaaaggggctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggcctcccggctcctcatctatggtacatctagcaggccactggcatcccagactaggttcaggtggcaggtgggtctggggacagaccttnactctacaccatcaagcagactgagtctagagtattttgctagttgttattattgtctagactaatatggtaggtctaccgtgggtactttggaccgtaggggaccaaggcgtaggagagtacgaaaacgactcgtacggctgaaccgaccatacctgttctctacttccg

SEQ ID NO: 317780 - DNA, 604 bp, Homo sapiens
  misc_feature: GZ8MTXP02HNKBC.10.79.H02.1.454.CMB.2.raw
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtcccnccaggctccgaggggaggggctgggagttgggtttccagtactatttatcgtagtggtnatacatatactacgcagactcgtggtagaacggggccgtattccacctatccctaccgacgggaaccaaaccgacccaaagaaccttcactgactttgactaaagtcgaaaccnccctagacgacgacccggaacggaccgaccgggaccgttaataacttaccgtggtacgaacgaacgtaaaccttaaccccggttcgacccgtttaggtttaactttacccg

SEQ ID NO: 317781 - DNA, 573 bp, Homo sapiens
  misc_feature: GZ8MTXP02JKAYN.10.79.H02.1.454.CMB.2.raw
  modified_base (474)..(474): a, c, t, g, unknown or other
  misc_feature (474)..(474): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggcctgggagggtccctgagactctcctgtgcagcctctggattcgcctctggattgacgttcagtgactacacatgacctgggtccgcaggctccgaggggaggggctggagtgggttcagtacatttatctagtggtgatacatatactacgcagactctggtagaacgggccgtattccacccatcctccgagggacaaccgccaaagacctcactgtactttgactaaatcgaaacnccctgacgacgccggacggacaccgggtcgtaactacgttaccgtggtacgaacgaagtaaacgttaccccggttcgaccgtttaggttactttacccg

SEQ ID NO: 317782 - DNA, 609 bp, Homo sapiens
  misc_feature: GZ8MTXP02JB6KI.10.79.H02.1.454.CMB.2.raw
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttgggtcaagcctgggagggtccctgagactctcctgtgcagcctctggattcgcctctggattgacgttcagtgactactacatgacctggtccgcaggctccgagggagggctggagtggttcatacatttanctagtgtnataccatatactacgcagtactctgtagaagggcctattcacccatcccgtaccgaagggaccaaaccggcccaaagaaccctcgacctagtaacctttgaacctaaagttacgaaacctaccccgtaggaccgaacggacccgaaagggaccaccggggacccttaagttacttaaccgtgtacggaaccgaaacgtaaccgttaaccccgttcggtaccctttagggtttaactttacccg

SEQ ID NO: 317783 - DNA, 538 bp, Homo sapiens
  misc_feature: GZ8MTXP02HM75O.10.79.H02.1.454.CMB.2.raw
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctntggattcgcctctggattgacgttcagtgactactacatcgacctgggtccnccaggctcgaggggagggctgggagtggttccatactatttatctaggtgtgatacatatactacgcagactntgtagagggcattcaccatcncgagggacaacgcaagaactcactgactttgacaaatcgaacaccctgacgagaccgaggacacggaccgtatacttactgtcgaacgacgaacgtaacccgttcgccgttaggtttaacttaccg

SEQ ID NO: 317784 - DNA, 546 bp, Homo sapiens
  misc_feature: GZ8MTXP02GRMED.10.79.H02.1.454.CMB.2.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (507)..(507): a, c, t, g, unknown or other
  misc_feature (507)..(507): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttgggtcaagcctgggagggtccctgagactctcctgtgcagcctctggattcgcctctggattgacgttcagtgactactacatgacctgggtccnccaggcctccgaggggaagggctgggagtggtttccatacatttancctagtgggtgataccatatactacgcagactctgtgaagggccgaattcaacctatcctaccgagggaccaacgccaaagactcactgacttgacaaatcgaaccaccgtgacgagccgaggacacgggcctatactacngtacgcgaagaactacccgtgaccttaggttacttaccg

SEQ ID NO: 317785 - DNA, 534 bp, Homo sapiens
  misc_feature: GZ8MTXP02GOTUL.10.79.H02.1.454.CMB.2.raw
  modified_base (321)..(321): a, c, t, g, unknown or other
  misc_feature (321)..(321): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (493)..(493): a, c, t, g, unknown or other
  misc_feature (493)..(493): n is a, c, g, or t
  modified_base (515)..(515): a, c, t, g, unknown or other
  misc_feature (515)..(515): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggattcgcctctggattgacgttcagtgactactacatcgaccgtgggtccnccgaggctccgaggggacggggctgggagtgggttccatacatttatcctagtggtgataccaatactactacgcagactctgtgaaggcattcacatcncaggacaacgccaaagactnactgacttgacaaatcgaacncccngcgagccgagacacggcctatactacngtagaacgagaactacccggtntccgtaggttactttaccg

SEQ ID NO: 317786 - DNA, 556 bp, Homo sapiens
  misc_feature: GZ8MTXP02FZ45A.10.79.H02.1.454.CMB.2.raw
  modified_base (468)..(468): a, c, t, g, unknown or other
  misc_feature (468)..(468): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctggtccgccaggctccgaggggagggctggagtgggttccatacatttatcctagtggtgataccatatactacgcagactctgtgaagggccgattcaccatctccgagggaccaaacgaccaaagaactcactgtactttgactaaatcgaaacnccctgacgagccggagaccgacggaccgtatacttactggtcgaacgaacgtaaacgtaacccgttcgaccgttaggttactttaccg

SEQ ID NO: 317787 - DNA, 577 bp, Homo sapiens
  misc_feature: GZ8MTXP02HKBED.10.79.H02.1.454.CMB.2.raw
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
  modified_base (384)..(384): a, c, t, g, unknown or other
  misc_feature (384)..(384): n is a, c, g, or t
  modified_base (489)..(489): a, c, t, g, unknown or other
  misc_feature (489)..(489): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggaggtccctgagactctcctgtgcagcctctggacttcgcctntggattgacgttcagtgactactacatgaccgtgggtccnccgaggctccggaggggaggggctgggagttgggttacccatacgtatttactcctaggtggtnactacatatactacgcagactcgtggtagaaaggggtccctaattccaaccatccaccgagggaacaaccgcaaagactcactagtacttgacaaatcgaaaccnccgtagacgacgaccgaggaccgacggtctatactacgtggacgaacgtaacgtaaccgttacccgtcgtaccgttaggtttactacg

SEQ ID NO: 317788 - DNA, 541 bp, Homo sapiens
  misc_feature: GZ8MTXP02IK2HR.10.79.H02.1.454.CMB.2.raw
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctggagggtccctgagactctcctgtgcagcctctggattcgcctctggattgacgttcagtgactactacatgacctgggtccncaggctccgaggggagggctggagtggttcatacatttanctagtgtnataccatatactacgnagtctcngtgaaggccatcacntcncgaggacaacgcaagactcactnacttgacaaagtgaacacccgtgacgacgccgaaggacacggtacctaattacgttactggtgaacgagtaaaccttaacccgttcgaccctttggttaactttacccg

SEQ ID NO: 317789 - DNA, 594 bp, Homo sapiens
  misc_feature: GZ8MTXP02HV1EG.10.79.H02.1.454.CMB.2.raw
  modified_base (197)..(197): a, c, t, g, unknown or other
  misc_feature (197)..(197): n is a, c, g, or t
  modified_base (359)..(359): a, c, t, g, unknown or other
  misc_feature (359)..(359): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggcctccccgggctccctcatctatagtacatctagcaggccatggcatcccagacaggtcagtgcagtggtctgggacagacttcnctctcaccatccagcagactgagtctgaagtattttgctagttgttaattagttgtactagtactaaagttagtagggttaggtactaccgttagggtacgttttcgggccgtaacggggaccgtaaaggtacgtagggacgtagtaaccgaaaacggtaaaccgttaggtacgggtaccgtacggaaccgtacccgtaacgttccgttacgtttccttaccttacgtttccccg

SEQ ID NO: 317790 - DNA, 537 bp, Homo sapiens
  misc_feature: GZ8MTXP02IS5LN.10.79.H02.1.454.CMB.2.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (411)..(411): a, c, t, g, unknown or other
  misc_feature (411)..(411): n is a, c, g, or t
  modified_base (452)..(452): a, c, t, g, unknown or other
  misc_feature (452)..(452): n is a, c, g, or t
  modified_base (490)..(490): a, c, t, g, unknown or other
  misc_feature (490)..(490): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctgggaggtccctgagactctcctgtgcagcctctggattcgcctntggattgacgttcagtgactactacatgacctgggtccnccaggctccgagggagggctggagtggtttccatacatttatcctagtgtgataccatatactagcagactctgtgaagggcattcaccatcncaggacacgccaaagactcactgacttgacaaatcgaaacnccctgacgacgccgaggacaccggacgtaatacttacngtcgcgtacgaaacttaccccggtctaccgttggtttaactttaccg

SEQ ID NO: 317791 - DNA, 582 bp, Homo sapiens
  misc_feature: GZ8MTXP02I8EGZ.10.79.H02.1.454.CMB.2.raw
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (461)..(461): a, c, t, g, unknown or other
  misc_feature (461)..(461): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggagggtccctgagactctcctgtgcagcctctggatcgcctctggattgacgttcagtgactactacatgacctggtccncgaggctccgagggagggctggagtggttcatactattanctagtgtnatacatatactacgcagactctgtagaaggcattcaccatctcgaggaccaaacgccaaagaacctcgaacttgaactttgaactaaagtcgaaaccncccgtagaccgacgacccggaggaaccgaccgggacccgttaattacgttaaccgtggtacgaacggtaaacgtaaaccgttaacccccggttcggaccctttagggttaactttacccgg

SEQ ID NO: 317792 - DNA, 613 bp, Homo sapiens
  misc_feature: GZ8MTXP02JRWKL.10.79.H02.1.454.CMB.2.raw
  modified_base (327)..(327): a, c, t, g, unknown or other
  misc_feature (327)..(327): n is a, c, g, or t
  modified_base (396)..(396): a, c, t, g, unknown or other
  misc_feature (396)..(396): n is a, c, g, or t
  modified_base (479)..(479): a, c, t, g, unknown or other
  misc_feature (479)..(479): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgcccagtgtcaggtgaagctggtggagtcgtgggggagcttggtcaagcctgggagggtccctgagactctcctgtgcagcctcgtggacttccgcctcgtggtattgacgttcagtgactactacatcggacctggggtcccnccgaggcctacccggaggggaacggggctggggaggttggttacccagtactatttatccgtagtggtnactacatatacgtacgcagactctggtacgaagggtcccattcacctatccgtaccgagggaaccacgtaccaaagtaccctnacttgtacctttagacctaaatcgaaacctccctgaccgacgcccgggaagtaccgacgggtacctaatacgttacgtggtcgaacgtaaacgtacgttaccccggttgtacccgtttagttaacgtttacccg

SEQ ID NO: 317793 - DNA, 510 bp, Homo sapiens
  misc_feature: GZ8MTXP02GNA61.10.79.H02.1.454.CMB.2.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (467)..(467): a, c, t, g, unknown or other
  misc_feature (467)..(467): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctccccgggctccncatctatggtacatcagcaggccagtggcatcccagacaggtcagtcggcagtgggtctgggacagcttcactctcaccatcagcagactggagtctagtaagtgtttgctagttgttatttattgtacagtctaatagtggtagtctacgtggtactttggcgtagggacagcgnggagatacaacgactaggtgcgtgactaccatctcgtacttac

SEQ ID NO: 317794 - DNA, 594 bp, Homo sapiens
  misc_feature: GZ8MTXP02FY50Y.10.79.H02.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (494)..(494): a, c, t, g, unknown or other
  misc_feature (494)..(494): n is a, c, g, or t
  modified_base (540)..(540): a, c, t, g, unknown or other
  misc_feature (540)..(540): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctntggattcgcctctggattgacgttcagtgactactacatgaccgtgggtccncgaggctccgaggggagggctggagttggttccatacatttancctagtggtgataccattatactacgcagtactcgtgtaggaaacgggccgaatttccaacctatccgtacccgaaggggaccaaaccgcccaaagaacctcactgtaacctttgacctaaaatcgaaaccncccgtgcgaagcccggaaggaccgacggtaccgtaattacttacgngtacgaacgtaagaaccgttaaccccggttcgaccttaggtttaacctttaccg

SEQ ID NO: 317795 - DNA, 569 bp, Homo sapiens
  misc_feature: GZ8MTXP02JST97.10.79.H02.1.454.CMB.2.raw
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagcatagtagtgcacgaccggtgctcgatttagtgtcacacgaagggaaaggggagctctgggagaagagccccagccccagaattcccaggagtttccattcggtgatcagcatgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggatcgcctctggattgacgttcagtgactactacatcgacctgggtccncaggctcgagggagggctggagtggttccatacatttanctagtggtgataccatnactacgcagactcgtgtgaagggcccgattcacctatcctacgacggaacacgacaagacnctacgtagtacttnaactaaacgtacgaaccaccgtcgacgacgaccggacggtaccaaaccggtcgttatacttacgtagtacgaacgtaaacgtaccgtacccggttactccgttacggtttaccaaaaaccg

SEQ ID NO: 317796 - DNA, 525 bp, Homo sapiens
  misc_feature: GZ8MTXP02HNAGH.10.79.H02.1.454.CMB.2.raw
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagcctggagggtccctgagactctcctgtgcagcctctggattcgcctctggattgacgttcagtgactactacatgacctggtccnccaggctccgagggagggctgggagtgggtttccatacatttanctagtggtgataccatatactacgcagactctgtgaagggccattcacntcncaggacaacgcaaagactcactgacttgacaaatgaacnccctgcgagccgagcacggcgtatacttactgtgaacganaactacccggtanccgtcggttactttaccg

SEQ ID NO: 317797 - DNA, 551 bp, Homo sapiens
  misc_feature: GZ8MTXP02F1HO3.10.79.H02.1.454.CMB.2.raw
  modified_base (318)..(318): a, c, t, g, unknown or other
  misc_feature (318)..(318): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccnccaggcctccgaggggagggctggagtgggttccagtacatttatctagtggtgactacatatactacgcagactctgtagaagggccgtattcacctatcctccgagggacaaacgccaaagacctnactgacttgacaaatcgaaaccncagcgagaccgagacgacggactatacgtacgngtacgaacgtaacgtaaccgttacccgtcgtaccgttacgttacttacg

SEQ ID NO: 317798 - DNA, 566 bp, Homo sapiens
  misc_feature: GZ8MTXP02JM62A.10.79.H02.1.454.CMB.2.raw
  modified_base (322)..(322): a, c, t, g, unknown or other
  misc_feature (322)..(322): n is a, c, g, or t
  modified_base (492)..(492): a, c, t, g, unknown or other
  misc_feature (492)..(492): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagccgtgggagggtccctgagactctcctgtgcagcctctggattcgcctctggattgacgttcagtgactactacatcgacctgggtcccncaggctccgagggagggctggagtgggttcatactatttactccgtagtggtgataccatatactacgctacgactcgtgtggaacgggccgtattccaacctatcccgtaccgaggggaacaaaccgaccaaagacctcaacctaggtactttgactaaatcgaaaccnccgtgacgacgccgagacaacggctatacgtactgtgaacgataaacgtacccgtgccgttaggttacttaccg

SEQ ID NO: 317799 - DNA, 558 bp, Homo sapiens
  misc_feature: GZ8MTXP02FJ6SB.10.79.H02.1.454.CMB.2.raw
  modified_base (319)..(319): a, c, t, g, unknown or other
  misc_feature (319)..(319): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaaggtgtcagtgtcaggtgaagctggtggagtcgtgggggaggcttggtcaagcctgggagggtccctgagactctcctgtgcagcctctggattcgcctctggattgacgttcagtgactactacatgacctggggtccnccgaggcctccgaggggaaggggctgggagtgggttccatacatttatctagtggtgactacatatactacgcagactctgtagaagggccattcacatcncaggacaacgccaaagactcactgacttgacaaatgaaaccnccngcgacgccgaggacacggaccgttaatacttacgtgtacgaacggtaacgtaaaccgttaccccggttcgaccgttacggtttaactttaccg

SEQ ID NO: 317800 - DNA, 529 bp, Homo sapiens
  misc_feature: GZ8MTXP02FXGPH.10.79.H02.1.454.CMB.2.raw
  modified_base (317)..(317): a, c, t, g, unknown or other
  misc_feature (317)..(317): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccnccaggctccgaggggagggctggagtgggttccatacatttatctagtggtgataccattatactacgcagactctgtgaagggccattcaccatctcgaggacaacgcaaagactcactgacttgacaaatgaaccnccngcgagccgaggacacggcgtatacttactgtgaacgaagtaactacccggtntaccgtggttactttaccg

SEQ ID NO: 317801 - DNA, 661 bp, Homo sapiens
  misc_feature: GZ8MTXP02FTLFG.10.79.H02.1.454.CMB.2.raw
  modified_base (322)..(322): a, c, t, g, unknown or other
  misc_feature (322)..(322): n is a, c, g, or t
  modified_base (600)..(600): a, c, t, g, unknown or other
  misc_feature (600)..(600): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattccgcctctggattgacgttcagtgactactacatcgacctgggtcccnccaggcctccgaggggaacgggctgggaggttgggtttccagttactatttactcctagtggtgataccattatactacgcagtactcgtaggtgaaacggggccctatttacccaacctatcccgtaccgaaacggggaccaaaacccggacccaaaaggtaaacccttccaacgttacgggtaaccttttacggaactaaaaagttcgaaaaccctccccgagggaccgaacggacccggacgggaaccaccggggtaccttaagttacttaacgngttacggaacgaaagtaaaccgttaccccgttcgtacccgtttaggtttactttaacccgg

SEQ ID NO: 317802 - DNA, 547 bp, Homo sapiens
  misc_feature: GZ8MTXP02FZ8L1.10.79.H02.1.454.CMB.2.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggattcgcctctggattgacgttcagtgactactacatcgaccgtgggtcccnccgaggcctccgaggggaggggctgggagttgggtttccatacatttancctagtggtnataccatatactagcagactntgtagaacgggccattccaccatctaccgagggacaaccgccaaagacctcactagactttgacaaatcgaacacctgcgagccgagacacggccgtaatacgttacngtagcgaagaactacccgtgacctaggttacttaccg

SEQ ID NO: 317803 - DNA, 644 bp, Homo sapiens
  misc_feature: GZ8MTXP02HZPUB.10.79.H02.1.454.CMB.2.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgtgctattataaaggtgtcagtgtcaggtnaagctggtggagtcgtgggggagcttggtcaagcctgggagggtccctgagactctcctgtgcagcctcgtggattccgcctctggattgacgttcaggtnaactactacntcgaccgttgggccccncgacggcctcggaaggggagggctgggagtggttccatacgtatttatctaggtggntaatacatataccgagcagtactcgtaggtagaaacgggccctaattccaaccctattccgacccgaggggaaccaaaccggacccttaaaaggaaccttaccaattcggaaccttttaggaaaccaaagttacgaaaccctaaccccggtacggaccgaacggaccggaaacggtaccgaaccggtaccttaacttaacttacgtacgtacggaacgtaaacgtaaaccgttacccgttcgtaccgttacggttttaacctaccg

SEQ ID NO: 317804 - DNA, 530 bp, Homo sapiens
  misc_feature: GZ8MTXP02HM3Y7.10.79.H02.1.454.CMB.2.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacntgacctgggtccncaggcctccgaggggagggctgggagtgggttccatacatttatctagtggtgatacatatacacgnagctntgtgaaggcattcacatcncgaggacaacgccaagactcactgactttgacaaatcgaacaccctgacgacgccgaggacacggactactactacgtgtcgcgacgtaactacccgttcgccgtacggtttactttaccg

SEQ ID NO: 317805 - DNA, 647 bp, Homo sapiens
  misc_feature: GZ8MTXP02HFYR9.10.79.H02.1.454.CMB.2.raw
  modified_base (369)..(369): a, c, t, g, unknown or other
  misc_feature (369)..(369): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggacttccgcctctggattgacgttcagtgactactacatcgacctgggtcccgccgaggcctccggaggggacgggcgtggtaggttggttccatactntttatcgtagtggtgataccattatactacgcagactctaggtaggaaacggggcctaagttcaaccctatccctaccggagggaaccaaacccgaccaaacgaaacccttcgaacttacgtaactttacgaaacctaaaagtacgaaaccctaccccgacgaccggaacgaccccggaaaggacccgaacggtacccgttaaattacgttaccgtggtacgaaccggaaagtaaaccgttaccccggtcgtaccgtttacggtttaactttacccgg

SEQ ID NO: 317806 - DNA, 610 bp, Homo sapiens
  misc_feature: GZ8MTXP02G8PK2.10.79.H02.1.454.CMB.2.raw
  modified_base (332)..(332): a, c, t, g, unknown or other
  misc_feature (332)..(332): n is a, c, g, or t
  modified_base (412)..(412): a, c, t, g, unknown or other
  misc_feature (412)..(412): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgtgctattataaaggtgtccagtgtcaggtgaagcgtgggtggagtcgtgggggaggtcgttggtcaagccgtgggacgggtccctgacgactctcctgtgcagcctctggacttcgcctcgtggattgacgttcagtcgactactacagtcgaccgtggggtcccnccgaggccgtaccgagggggaacggggctggggagtggtccctttacgacttaacgtattttactccgttaggtgggtanactaccatactactacgcaagactcgtgtaggaacgggccctattccactatcctaccgaagggaccaaccgaccaaagtacctcacgtntaccgttgaacctaaagtcgaactacccgtgacgacgccgaggaccacggcctaattactacgtgaacgtcgaaacgtaccgtaacccgttcggaccttaggtttacc

SEQ ID NO: 317807 - DNA, 602 bp, Homo sapiens
  misc_feature: GZ8MTXP02H9ES1.10.79.H02.1.454.CMB.2.raw
  modified_base (271)..(271): a, c, t, g, unknown or other
  misc_feature (271)..(271): n is a, c, g, or t
  modified_base (327)..(327): a, c, t, g, unknown or other
  misc_feature (327)..(327): n is a, c, g, or t
  modified_base (396)..(396): a, c, t, g, unknown or other
  misc_feature (396)..(396): n is a, c, g, or t
  modified_base (511)..(511): a, c, t, g, unknown or other
  misc_feature (511)..(511): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttctgttgctattataaaggtgtccagtgtcaggtgagcgtggtggagtcgtgggggagcttggtcaagccgtggacgggtccctgagactctcctgtgcagcctcgtggnttcgcctctaggtatcgtacgttcagtcgactactacatcgacccgtggggtcccnccgaggcctaccggaggggaacgggcgtggggaggttcgggttccagttactatttactctaggtggtnacttacattactactacgctagacctgtgtaggaaggtcgattaccgactatccgacgaggaccaacgaccaaacgactcactagtactttagaacaaagtacgaacctacccgngaccgacggccgaaggaccgacgtaccgtaattacgtacgtgtacgaacgaacgtaaccgttacccgtcgtaccgttaggtttactaccgg

SEQ ID NO: 317808 - DNA, 535 bp, Homo sapiens
  misc_feature: GZ8MTXP02GR6XO.10.79.H02.1.454.CMB.2.raw
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtctaggggaggcttggtcaagcctggagggtccctgagactctcctgtgcagcctctggattcgcctctggattgacgttcagtgactactacatgaccctgggtccgccaggctccgaggggagggctggagttgggttccatactatttatcctagtggtgatacatatactacgcagactctgtgaagggccattcaccatcncaggacaacgcaaagactcactgactttgacaaatcgaaacnccctgcgagccgaggacacggccgtatactacgtgtcgcgtagaaacttacccgtcgaccttaggtttactttaccg

SEQ ID NO: 317809 - DNA, 622 bp, Homo sapiens
  misc_feature: GZ8MTXP02F1U2S.10.79.H02.1.454.CMB.2.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgagctggtggagtcgtgggggaggcttggtcaagcctggacgggtccctgagactctcctgtgcagcctctggattcgcctctggattgacgttcagtgactactacatgacctgggtccnccaggctcgaggggagggctgggagtgggtttcatactatttacnctagtggtgatacatactactacgcagactctggtagaacgggtccgattccacctatcctaccgaacgggacaaaccggaccaaagaaactccaactcggtaactttcgaactaaatcggaaaaccctacccgtaggacgacggacccggacgggaaccaccggggtaccttaaagtacgtttaacgtggtacggaaccgtaacggtaaaaccgttaaccccggttcgtacccgtttagggtttaactttaacccgg

SEQ ID NO: 317810 - DNA, 640 bp, Homo sapiens
  misc_feature: GZ8MTXP02F90XN.10.79.H02.1.454.CMB.2.raw
  modified_base (267)..(267): a, c, t, g, unknown or other
  misc_feature (267)..(267): n is a, c, g, or t
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggagggtccctgagactctcctgtgcagcctntggattcgcctcgtggattgacgttcagtgactactacatcgacctgggtcccncgaggcctaccgaggggagggctgggaggttgggttccagtactatttactcgtagtggtgactaccatactactacgctagtactcgtaggtaggaacgggtcctaagttaccacccgtacttccgacccgaaggggaaccaaaccggcccaaaagtacctccgaacttacggtaacctttacgaaactaaaacgtcgaaaccctcccgtaggacgacggacccggaggacccacgggtaccgttaattacgttacgtgtacggaacgtaaacgtaaaccgttacccggttcgtaccgttacggtttaactttacccg

SEQ ID NO: 317811 - DNA, 579 bp, Homo sapiens
  misc_feature: GZ8MTXP02GYNBK.10.79.H02.1.454.CMB.2.raw
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtcctgagactctcctgtgcagcctctggattcgcctctggattgacgttcagtgactactacntgacctgggccncgaggcctcgaggggacgggctgggagtgggttccagtactatttatcctaggtggtgataccatatactacgcagtactntgtgaagggcctattccactatcctacgagggacaacgccaaacgactcacgtnacttagactaaagtcgaaaccacccgtgaccgagaccggacggaccgacgggtacctaagtacttaccgtggtcggaacgtaacggtaaacttaccccggtcgtaccgttagggtttaactttacccg

SEQ ID NO: 317812 - DNA, 594 bp, Homo sapiens
  misc_feature: GZ8MTXP02IBYO4.10.79.H02.1.454.CMB.2.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgagctggtggagtcgtgggggagcttggtcaagcctggagggtccctgagactctcctgtgcagcctntggnttcgcctctggattgacgttcagtgactactacatgacctgggtccnccaggcctccgaggggagggctgggagtgggtttcagtactatttactcctagtggtnaacttaccattactactacgcaagtacctctggtagaacggggtcccatttccaacctattccacccgaggggaccaaacggcccaaagaacctcactgtactttgactaaaagtcgaaaccacccgtgaccgaacgcccggaaggaccacggtccgttaattacgttacgtggagaacgtagaaacttacccgttcgcctttaggtttactttacccg

SEQ ID NO: 317813 - DNA, 557 bp, Homo sapiens
  misc_feature: GZ8MTXP02FYEWK.10.79.H02.1.454.CMB.2.raw
  modified_base (198)..(198): a, c, t, g, unknown or other
  misc_feature (198)..(198): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaangccacgctctcctgcagggccagtcagagtctagcagcaactacgttgcctggtaccaacagaaacctggccaggcctcccgggctccgtcatctatggtacatctagcaggccacgtgcactccagacaggttcaggtcggcaggtgggtctgggacaggtcttcacttcacaccatcagcagactggatctagtaaacgtnttttagctagttagtatttagttgtacagtactaattagtaggtacggtacctacgttgggttacgtttcggaccgtaggggacctaaggcgttagggaacaacgtacgaaaacggtacgtgtacgcgtcgaactaccgtatcgtcgttactaccg

SEQ ID NO: 317814 - DNA, 593 bp, Homo sapiens
  misc_feature: GZ8MTXP02JGGPH.10.79.H02.1.454.CMB.2.raw
  modified_base (126)..(126): a, c, t, g, unknown or other
  misc_feature (126)..(126): n is a, c, g, or t
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (580)..(580): a, c, t, g, unknown or other
  misc_feature (580)..(580): n is a, c, g, or t
tcagcatagtagtgcacgaccggtgctcgatttagtgtcacacgaagggaaaggggagagctgctcagttaggacccgagggaaccatggaaaccccagcgcagcttctcttcctcctgctactcnggctccagatccctaccggagaaattgtgttgacgcagtctccaggcaccctgtctttgctccaggggaaangccacgctctcctgcagggccagtcagagtcttagcagcaactacgttncctggtaccaacagaaaccngccaggcctcccgggctcctcatctatggtacatctagcagggccacgtggcacgtcccagacaggttcagtcggcaggtggtcgtgggacagtcncgtactctcacnctacgagcgagtaccgtagggtnaacggttcttggaaacgttgtttggacttaggttcgttaatagtttgtactagacgtaaagttagtagggtaggtacctacgggttcctttagggttacgtacgggtaccgggtaacggaacgtcgtacggtaaacggtactaacggaaaaccgtaacgtggtcgtacgtcgacctaccgtntaacgttactacg

SEQ ID NO: 317815 - DNA, 578 bp, Homo sapiens
  misc_feature: GZ8MTXP02ISKEF.10.79.H02.1.454.CMB.2.raw
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctgggtggagtcgtgggggagcttggtcaagcctggagggtccctgagactctcctgtgcagcctctggattcgcctntggattgacgttcagtcgactactacatgaccgtggggtccnccaggcctcgaggggagggctgggagtgggtttccagtactatttactcctaggtggtgataccattactacctacgctaagactctggtacgaaaggggccctaattccacccatccctaccaggggacaaaccggccaaagaactcactgtacttgacaatcgaacaccctgcgacgccgagaaccncgggtacctagtacttacgtgtacgaacggaagtaaacctacccggttcgccttcggttaactttaccg

SEQ ID NO: 317816 - DNA, 568 bp, Homo sapiens
  misc_feature: GZ8MTXP02J1RCI.10.79.H02.1.454.CMB.2.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
tcagcatagtagtgcacgaccggtgctcgatttagtgtcacacgaagggaaagggagctctgggagaagagccccagccccagaattcccaggagtttccattcggtgatcagcactgaacacagaggactcaccatggagtttgggctgagcgtggttttcctgttaggctattataaaaggtgtccagtgtcaggtgaagctggtggagtctgggggagcttggtcaagcctggagggtccctgagactntcctgtgcagcctcnggatcgctctggtntgtcgtngtgactactacatgcgtcggtccgcgcgcgcgaggaggngtggtggtggttcgtatactattatctagtgtgactactatatactacgacacgtactcgtgtaggaacggacgtactaccacctactaccgtaccgacgaaccgaaccgaaccgaaacgaactactactacgtacgttacgtaactaactaacgaacaccacgacgacgacgacgacgacgacgtactacgtactgtacgaacgtacgtaacgtaaccgtacgtcgttacgttacgtacg

SEQ ID NO: 317817 - DNA, 540 bp, Homo sapiens
  misc_feature: GZ8MTXP02GX10X.10.79.H02.1.454.CMB.2.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (461)..(461): a, c, t, g, unknown or other
  misc_feature (461)..(461): n is a, c, g, or t
  modified_base (497)..(497): a, c, t, g, unknown or other
  misc_feature (497)..(497): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctggagggtccctgagactctcctgtgcagcctctggattcgcctntggattgacgttcagtgactactacatcgacctggtccnccaggctccgaggggagggctggagttggttccagtactatttactctagtggtnataccatatactacgcagactntgtgaaggcctattccacatcncgaggacaacgcaaagactcactgactttgacaaatcgaaaccncctgacgacgaccgaggacaccggcgtaatactacngtacgaacgtagaaactacccgtcgaccttaggttacttaccg

SEQ ID NO: 317818 - DNA, 710 bp, Homo sapiens
  misc_feature: GZ8MTXP02G1768.10.79.H02.1.454.CMB.2.raw
  modified_base (324)..(324): a, c, t, g, unknown or other
  misc_feature (324)..(324): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgtgctattataaaggtgtccagtgtcaggtgaagcgtggtggagtcgtgggggaggcttggtcaagccgtggagggtccctgagactctcctgtgcagcctcgtggattcgcctctggattgacgttcagtcgactactacatcgaccgtggggtccnccgaggcctaccggaaggggacggggctaggggaggttggggtttaccagttactattttactccgttaggttgggtgtaacttaaccgaattactaaccgtacggactaacgtacttcgtaggtacgggaaacggggcccgtaattacccaacccacttacccgtaccgaacggggaacccaaaccggaccctaaaacggtaaccctaccaaccgtttacggttaacctttacggaacctaaaagttcggaaaaccccaccccggttaggaccggaaccgggacccggaacggggaaccaccggggtacccttaagttacttaaccgtggttacgaacgaacgtaaaccgttacccgtcgtaccgtttacggtttaactttaccg

SEQ ID NO: 317819 - DNA, 516 bp, Homo sapiens
  misc_feature: GZ8MTXP02G51YI.10.79.H02.1.454.CMB.2.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccatggcatcccagacaggtcagtcggcagtgggtctggggacagcttcactcncaccatcagcagactggagtctagaaagtntttgacgtagtgttatttattgtcagtacaattagtggtagtcacgtgggtactttggaccgtaggggacctaaggcgtaggacgatacaaacgactgtgctgacacagtctcgtctcg

SEQ ID NO: 317820 - DNA, 530 bp, Homo sapiens
  misc_feature: GZ8MTXP02JLPO1.10.79.H02.1.454.CMB.2.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctgggagggtccctgagactctcctgtgcagcctctggattcgcctctggattgacgttcagtgactactacatgacctgggtccncaggctcgaggggagggctggagtggttccagtacatttancctagtggtgactacatatactacgcagtactctggtacgaagggcctaattcacccatccnccgagggaccaacgccaaagactcactgacttgacaaatcgaacncctgcgagccgagacacggctatactacgngtcgcgagaactacccgtcaccgtgttacttacg

SEQ ID NO: 317821 - DNA, 732 bp, Homo sapiens
  misc_feature: GZ8MTXP02JHEEC.10.79.H02.1.454.CMB.2.raw
  modified_base (682)..(682): a, c, t, g, unknown or other
  misc_feature (682)..(682): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctgggtggagtcgtgggggaggcttggtcaacggccgtgggacgggtccctgacgactctcctgtgcagcctcgtggtacttccggccttcgtgggtattcggacgttcagtacgaacttaactacatcggaccgtcggggtccccgccgacgggtcccgtaccggaaggggaaacggggtcgtggggtacggtttcggggtttaccctaacgttacttaatttttaacgtacccgttagggttacgggttagtaaacgttaaccctaaagttaaacttaaccgtaaccgtacaggttaacctcgttaggtacggggaacggtcccgtattaccacccgtactcccgtaccgaacgggaccaaaaccggacctaaaacgaacccttccgaaccttaggttaacctttacgaaactaaaacgtcgaaaccctacccgagaccggacggaccgacggaccgaccggtacttaagtcttaacgngtacgaacgtaacgtacgttaacccgtcgtaccgttaggtttacttaccg

SEQ ID NO: 317822 - DNA, 687 bp, Homo sapiens
  misc_feature: GZ8MTXP02F21H7.10.79.H02.1.454.CMB.2.raw
  modified_base (331)..(331): a, c, t, g, unknown or other
  misc_feature (331)..(331): n is a, c, g, or t
  modified_base (633)..(633): a, c, t, g, unknown or other
  misc_feature (633)..(633): n is a, c, g, or t
tcagcatagtagtgcacgaccggtgctcgatttagtgtcacacgaagggaaaggggagatctgggagaagagccccagccccagaattcccaggagtttccattcggtgatcagcactgaacacagaggactcaccatggagtttgggctgagcgttgggttttccttgttgctattaataaaaggtgtccagtgtcaggtgaagctggtggagtcgtgggggagcttggtcaagcctgggacgggtccctgagactctcctgtgcagcctctggattccgcctctgggattggacgttcagtgacttactacatcgaccgtggggtcccnccgaggcctaccggaagggggaacgggcgtaggggaggttcggggtttaccagttacctattttactccgttaaggttgggtgtactaacctattaactaccttaacggcaggtaccttcgtaggtaggaaacggggtccctaattccaacctatccgtacccgaaggggtaaccaacccggaaccaaacggtaaaccctctaaccttaggtaaccctttagaacccaaaagttcgaaaacccacccgtaggaccggaacgtacccggaaagggacccacgggtaccttaatacgtttacgnggtacgaacgtaacgtaaaccttacccggttcgtacgtttacgtttacttaccg

SEQ ID NO: 317823 - DNA, 636 bp, Homo sapiens
  misc_feature: GZ8MTXP02GVRJS.10.79.H02.1.454.CMB.2.raw
  modified_base (330)..(330): a, c, t, g, unknown or other
  misc_feature (330)..(330): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctggttttccttgttgctattataaaggtgtccagtgtcaggtgaagctggtggagtcgtgggggaggcttggtcaagccgtgggagggtccctgagactctcctgtgcagcctcgtggacttcgcctcgtggattgacgttcagtgaacctactacatcggaccgtcggggtcccnccgaggcctaccggaagggggaaggggctggggaggttgggttccatactatttactcgtagtggtnataccattacactacgcagactcgtagtagaacgggcctattaccacctatcctaccgaagggaccaaaccgccaaaagaaccttcacgttagtactttacgaactaaaagtcgaaaccctacccgtggaccgacggacccggaagggtaacccaaccggtaccgttaaattacgttaacgtgtacgaacgtaaagtaaaccgttaaccccgtcgtaccgttacggtttaacttacccg

SEQ ID NO: 317824 - DNA, 558 bp, Homo sapiens
  misc_feature: GZ8MTXP02JS5LH.10.79.H02.1.454.CMB.2.raw
  modified_base (198)..(198): a, c, t, g, unknown or other
  misc_feature (198)..(198): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtctagcagcaactacgttgcctggtaccaacagaaacctggccaggcctcccgggctcctcatctatggtacatctagcaggccatggcatcccagactaggttcaggtggcaggtgggtctggggacngaccttcnctctcaccatcgagcagacgtggagtctaggaagtagtttgactagttgttattattgtacagtactaagtagtgggttacgtctaccggttggttacgtttcgggaccgtagggggtaccaggtcgttaggagtacgtacaaacggtacgtggtacgctagccgtactactcgtacgtcttacgactttcccg

SEQ ID NO: 317825 - DNA, 867 bp, Homo sapiens
  misc_feature: GZ8MTXP02HN2SX.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatcgacccgtgggtcccgccgaggcctaccggaggggaacggggctggggaggttggggtttcccagttaccgtattttactcccgttaggttcggtggtaacttaaccctaattacttaaccgtacggctaaacgtaaccttccgtaggttacgggaaaacgggggtccccgttaagtttaccccaaacccctaacgttaccccgtaaccccgggaaacgggggtaaacccaaaaacccggggtacccccaaaaaacgggtaaaccccctttacccgaaacccgtttacgggtaaacccttttttaccggggaaaccttaaaaaacgttccgggaaaaacccccttacccccgttacggggaacccggaaacccgggggacccccggtaaaacgggggaaacccgaaaccccgggggttacccccggtttaaaatttaaaccgttttaaaccccggttggggtttaccggaaccggtaaaacggttaaaaacccgtttaaacccccccggggtttcgtacccccggttttacgggggtttttaaaaccttttaacccccggg

SEQ ID NO: 317826 - DNA, 695 bp, Homo sapiens
  misc_feature: GZ8MTXP02GLK6S.10.79.H02.1.454.CMB.2.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactacacatcgacctggtccncaggctcgagggacgggctggagtggttcatacgatttacnctagtgtgataccatatactacgcaagtactcgtggtaggaaacggggccctaatttccaaccgtatccgtacccgaacggggaaaccaaacccggacccaaaaggtaaccctaccgaaaccttcgggtaaaccttttaggaacctaaaaacttcggaaaaaccccctacccgtacggaacccggacggaaccccgggtaagggaaaccccaccgggggtaccccgtttaaattaacgtttaaacccgtggttaaccggaacggtaaaacggtaaaacccgttaaaaccccccgggtttcgtacccggtttaacgggtttaacttttaaaaccccgg

SEQ ID NO: 317827 - DNA, 532 bp, Homo sapiens
  misc_feature: GZ8MTXP02I92IE.10.79.H02.1.454.CMB.2.raw
  modified_base (358)..(358): a, c, t, g, unknown or other
  misc_feature (358)..(358): n is a, c, g, or t
  modified_base (449)..(449): a, c, t, g, unknown or other
  misc_feature (449)..(449): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagccgtggagggtccctgagactctcctgtgcagcctctggattcgcctctggattgacgttcagtgactactacatgacctggtccgcaggctcgagggagggctggagtggttcatacatttanctagtgtgatacatatactacgcagactctgtagaggcgattcaccatctcgaggacaacgcaaagactcactgacttgacaaatcgaacncctgacgagccgagacacggccgtaatacttactgtcgaacgacgtaaacgtacccgttcgaccgttacggttactttacccg

SEQ ID NO: 317828 - DNA, 541 bp, Homo sapiens
  misc_feature: GZ8MTXP02F08QE.10.79.H02.1.454.CMB.2.raw
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
  modified_base (498)..(498): a, c, t, g, unknown or other
  misc_feature (498)..(498): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccnccaggctccgaggggaagggctgggagtgggttccatacatttatctagttggtnataccatactactacgcagactctgtgaagggcattcacatcncaggacaacgccaaagactcactgactttgactaaatcgaacncccgtagcgacgccgaggacacggccgtatacgttacngtcgaacgaagaactacccgtcgaccttacggttactttaccg

SEQ ID NO: 317829 - DNA, 580 bp, Homo sapiens
  misc_feature: GZ8MTXP02JPVCP.10.79.H02.1.454.CMB.2.raw
  modified_base (409)..(409): a, c, t, g, unknown or other
  misc_feature (409)..(409): n is a, c, g, or t
  modified_base (452)..(452): a, c, t, g, unknown or other
  misc_feature (452)..(452): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagcctgggagggtccctgagactctcctgtgcagcctctggattcgcctctggattgacgttcagtgactactacatcgacctgggtccgcaggctccgagggagggctggagtggttcatactatttatctagtgtgatacatatactacgcagactctgtgaaggcatcacatcncgaggacacgcaaagactcactgacttgactaaatcgaaaccncccgtagaccgacgaccggaacggaccgaaccgggtcccgttaattacgttaccgtggttacgaaccggtaacgaaaccgtttaacccccggttcggtaccccgtttagggtttaacctttaacccgg

SEQ ID NO: 317830 - DNA, 637 bp, Homo sapiens
  misc_feature: GZ8MTXP02JE8QC.10.79.H02.1.454.CMB.2.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatcgacctgggtccnccaggctccgagggaggctggagtggttcatacatttanctagtgtgataccatatactacgcagactctggtagaacggggcctaattccacctatcctaccgagggaaccaaaccggaccctaaaagaaccctacgaaccttacgtaacctttagaacctaaaatacggtaaacccacccccgtagacccgaacggaccccgggaaacggaacccgaccgggtaacccgttaaattacgttaccgtggtacgaacggaaacgtaaaaccgttaaacccccggttcgtacccgtttacgggtttaactttaacccgg

SEQ ID NO: 317831 - DNA, 556 bp, Homo sapiens
  misc_feature: GZ8MTXP02IZOUV.10.79.H02.1.454.CMB.2.raw
  modified_base (317)..(317): a, c, t, g, unknown or other
  misc_feature (317)..(317): n is a, c, g, or t
  modified_base (472)..(472): a, c, t, g, unknown or other
  misc_feature (472)..(472): n is a, c, g, or t
  modified_base (511)..(511): a, c, t, g, unknown or other
  misc_feature (511)..(511): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtaggggaggcttggtcaagcctggaggtccctgagactctcctgtgcagcctctggattcgcctctggattgacgttcagtgactacacatgacctgggtccncaggctccgaggggagggctggagtggttcatactatttactcgtagtgtgataccatactacacgcagtactctggtagaaacggggcctattcaccctatcctaccgagggaccaaacgccaaagactcacttgactttgacaaatcgaaacnccctgcgagacccggagacacgggaccttatacttacgngtacgcgaacgtaacttacccggtcaccgttggtttactttaccg

SEQ ID NO: 317832 - DNA, 606 bp, Homo sapiens
  misc_feature: GZ8MTXP02JYZ6X.10.79.H02.1.454.CMB.2.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccacgctctcctgcagggccagtcagagtctagcagcaactacgttgcctggtaccaacagaaacctggccaggcctcccgggctcctcatctatggtacatctagcaggccagtggcactcccagacaggttcagtcggcaggtgggtctgggacagcttcactctacaccatcagcagacgtgggagtcgtagtaagtagtttgactagttagttatttagttgtacagtactaagttagttagggtacggtccgtaaccggttggggttacgttttcggggaccggtaagggggtaaccctaagggtaccgttaggggaacgtaaacgtaaccgtaaaacggtaaccgttaggtacggtaacgtacggacctaccgtacttccgttcgttacctttaccg

SEQ ID NO: 317833 - DNA, 561 bp, Homo sapiens
  misc_feature: GZ8MTXP02HUCB3.10.79.H02.1.454.CMB.2.raw
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatgacctgggtccnccaggctccgaggggagggctggngtggttccatacntttanctagtgtgatacatatacacgcagactctgtgaaggccgattcaccatctccgaggacacgacaacgactacactgactttgacaaatcgaacacccgtgacgacgccgaacggaccgacggccgtaacgtacttaccgtgtacgaacgaacgtaaaccgttaaccccgttccgtaccgttacggtttaactttacccg

SEQ ID NO: 317834 - DNA, 612 bp, Homo sapiens
  misc_feature: GZ8MTXP02J3IDE.10.79.H02.1.454.CMB.2.raw
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (559)..(559): a, c, t, g, unknown or other
  misc_feature (559)..(559): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggttaagctggtggagtcgtgggggagcttggtcaagcctggacgggtccctgagactctcctgtgcagcctctggattcgcctcgtggattgacgttcagtgactactacatcgaccgtgggccnccgaggcctccgaggggacgggctgggaggttgggttacagtactagtttacnccgttaggtggtnactaccattactactacgctaagtacctcgtagtaggacgggtcgtacttccacctactccgtaccgaacgggaccaacgaccaaagaacctacgactacgtacctttagactaaacgtacgaaacctaccgtacgacgacggccgacggaccgacggaccgtatacgtacncgtagacgtaagtaaccgtacccgtcgtaccgtacggtttacttaccgtacgg

SEQ ID NO: 317835 - DNA, 577 bp, Homo sapiens
  misc_feature: GZ8MTXP02G75FF.10.79.H02.1.454.CMB.2.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagcttggtcaagcctggagggtccctgagctctcctgtgcagcctctggattcgcctctggattgacgttcagtgactactacatgacctggtccncaggctcgagggaggctggagtggttcatactattanctagtggtnatacatatactacgcagactctgtagaaggggccaattcaacctatcctaccgaaggggaaccaaacggcccaaaagaaccttacaaccgtgtaacctttaggaaccaaaatcgaaaacctccctagcgaacgccggaaggacaccgggtcctaaatacttaacgtgtagaacgaacgtaaactaacccggttcgtaccttaggtttaacttaaccg

SEQ ID NO: 317836 - DNA, 536 bp, Homo sapiens
  misc_feature: GZ8MTXP02JJG5I.10.79.H02.1.454.CMB.2.raw
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatgacctgggtccncgaggctccgagggagggctggagtggttcatactatttanctagtgtgataccatactactacgcanactctgtagaacgggcagttcaccatcctccgaggacaaacgccaaagactcactgactttgacaaatgaaccacctgacgacgccgaggacacggaccgtatacgtactgtgaacgagaactaccgtcgaccgttcggtactttaccg

SEQ ID NO: 317837 - DNA, 566 bp, Homo sapiens
  misc_feature: GZ8MTXP02HDRYP.10.79.H02.1.454.CMB.2.raw
  modified_base (465)..(465): a, c, t, g, unknown or other
  misc_feature (465)..(465): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctggagggtccctgagactctcctgtgcagcctctggattcgcctctggattgacgttcagtgactactacatgacctgggtccgccaggcctccgaggggagggctggaggttggttccatactatttactctagtgtgatacatatactacgcagactcgtgtagaagggccattcaccatcaccgaggacaacgccaaagactcactgacttgacaaatcgaaaccnccctgacgacgcccggaggaccacggtaccgttaatacgttacgtgtacgaacgaagtaaaccttaccccggttcgtacccttagggtttaactttacccg

SEQ ID NO: 317838 - DNA, 601 bp, Homo sapiens
  misc_feature: GZ8MTXP02IH97N.10.79.H02.1.454.CMB.2.raw
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccncaggctccgagggagggctgggagtgggttccatacatttacnctagtggtgatacatactacctacgctagactcngtagaacggggcctattaccacctatcctaccgaaggggacaaaccggaccaaacgaacttcacgttagtaccctttagactaaaactcgaaaccctacccgtgacgacgaccggacggaccgacggtacccgttaatacgtttaacgtgtaggaacgaaacgaaaccttaacccggtttgacccgtttaggttaactttaaccg

SEQ ID NO: 317839 - DNA, 585 bp, Homo sapiens
  misc_feature: GZ8MTXP02F1C31.10.79.H02.1.454.CMB.2.raw
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccnccaggcctccgaggggaggctggagtggttccatacatttatctagtggtnataccatatactacgcagactgtgtaggaaacgggccaattccacctatcctaccgaaggggaccaaaccggccaaagaacctcaccgtgtaacctttgaactaaatcgaaaacccnccgtagacgacgaccggacggaccgacggtactaattacgtacgtgtacgaacgtaacgtaaaccgttacccggttcgtaccgttacggtttactaccg

SEQ ID NO: 317840 - DNA, 527 bp, Homo sapiens
  misc_feature: GZ8MTXP02JBVY5.10.79.H02.1.454.CMB.2.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (449)..(449): a, c, t, g, unknown or other
  misc_feature (449)..(449): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagtctggagggtccctgagactctcctgtgcagcctctggattcgcctctggattgacgttcagtgactactacatgacctgggtccncaggctccgagggagggctggagtggttcatacatttanctagtgtgataccatactactacgcagactctgtgaagggccattcaccatctcaggacaacgcaagactcactgacttgacaatcgaacnccctgcgagccgaggacacggaccgtatactacgtgtagcgaagaaactacccgttcgaccgttaggttactttaccg

SEQ ID NO: 317841 - DNA, 579 bp, Homo sapiens
  misc_feature: GZ8MTXP02GEEC0.10.79.H02.1.454.CMB.2.raw
  modified_base (483)..(483): a, c, t, g, unknown or other
  misc_feature (483)..(483): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattaataaaggtgtccagtgtcaggtgaagctggtggagtcgtgggggaggcttggtcaagcctgggagggtccctgagctctcctgtgcagcctctggattcgcctctggattgacgttcagtgactacacatcgactcggtccgccaggctcgaggggacgggcgtggaggtgggttccagtactatttactccgttagtggtgactaccaatactactacgcagactcgtagtggaaacgggcctaattccacctatctccgaggaccaaacgccaaaagacctcactagtacttgacaaatcgaaacncccgtgacgagaccggaacgacgaccggtcgtaattacgttacgtgtagaaccgtaagtaaccgttaacccggtctcgttacggtttactttaccg

SEQ ID NO: 317842 - DNA, 613 bp, Homo sapiens
  misc_feature: GZ8MTXP02GDDMM.10.79.H02.1.454.CMB.2.raw
  modified_base (325)..(325): a, c, t, g, unknown or other
  misc_feature (325)..(325): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctcgtggattcgcctcgtggattgacgttcagtgactactacatcgaccgtggggtcccnccgaggcctccggaggggaggggctggggagttggggttccatactatttacnccgtaggtgtgataccattatacctacgcagtactcgtgtggaacgggtcctattaccgacctatcccgtaccgacggggaccaaaccggaccaaagaacctcaacgtcgtactttagactaaagtacgaaccacccgtgaccgacgccggaggaccgacggtaccgtattacttacgtggtacgaacgtaacgtaaccgttaacccgtcgtaccgttacggtttaactttaccg

SEQ ID NO: 317843 - DNA, 653 bp, Homo sapiens
  misc_feature: GZ8MTXP02GRNHM.10.79.H02.1.454.CMB.2.raw
  modified_base (263)..(263): a, c, t, g, unknown or other
  misc_feature (263)..(263): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggagggtccctgagactctcctgtcncagcctctggattccgctctggattgacgttcagtgactactacatcgaccgtggtccgcgacggcctccgaggggagggcgtagggagttggggtttccagtactattttactaccttaggtggtgtactaacctattactaactacgacaacggtactcgttaggtaggtaaacggggttctaactttaccaacctactaccgtaccgaacgggaaccaaacggacccaaaggacctactacctagtactttacgaaactaaacgtacaaacccgtacccgtgaccggacggaacccggaggaccgaccgggtactaacgttacttaaccgtggtcgaacgtaacgtaaccgttaaccccgtcggtaccttacggtttacttaacccg

SEQ ID NO: 317844 - DNA, 529 bp, Homo sapiens
  misc_feature: GZ8MTXP02HEPJF.10.79.H02.1.454.CMB.2.raw
  modified_base (200)..(200): a, c, t, g, unknown or other
  misc_feature (200)..(200): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (492)..(492): a, c, t, g, unknown or other
  misc_feature (492)..(492): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggcctcccgggctccctcatctatggtacatctagcaggccatggcactcccagaccaggttcagtcgcaggtgggtctggggacagcttcactctacaccntcagcagactggagtctagaagttntttgctagtgttatttagttgtcagtcaagttagtggtagtctacgttgggtactttgggaccgtaggggacctaaggcgtaggacgtanacgaaacgtagtgtaggctgacacgatctgtctttcg

SEQ ID NO: 317845 - DNA, 544 bp, Homo sapiens
  misc_feature: GZ8MTXP02F2EAB.10.79.H02.1.454.CMB.2.raw
  modified_base (316)..(316): a, c, t, g, unknown or other
  misc_feature (316)..(316): n is a, c, g, or t
  modified_base (460)..(460): a, c, t, g, unknown or other
  misc_feature (460)..(460): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaaggtgtccagtgtcaggtgaagctggtggagtcgtgggggagcttggcaagcctggagggtccctgagactctcctgtgcagcctctggattcgcctctggattgacgttcagtgactactacatgacctgggtccncaggctccgaggggagggctggagtgggtttccatacatttatcctagtggtgataccatatactacgcagactctgtgaagggccgattcacctatctcgaggacaaacgccaaagactcactgacttgactaaatcgaaacncccgtgacgacggaccgaggacacggccgtaatacgtacgtgtgccgaagaacttaaccccgttcgaccttaggttacttaccg

SEQ ID NO: 317846 - DNA, 559 bp, Homo sapiens
  misc_feature: GZ8MTXP02GZ5EI.10.79.H02.1.454.CMB.2.raw
  modified_base (316)..(316): a, c, t, g, unknown or other
  misc_feature (316)..(316): n is a, c, g, or t
  modified_base (469)..(469): a, c, t, g, unknown or other
  misc_feature (469)..(469): n is a, c, g, or t
  modified_base (507)..(507): a, c, t, g, unknown or other
  misc_feature (507)..(507): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccnccgaggctccgaggggagggctgggagttgggttcagtactatttactctagtggtgataccatactactacgcagactctgtagaagggcctattcactatctaccgagggacaacgcctaaagactcactgactttgacaaatcgaaaccncctgacgacgccgaggaccaccgggccttatacttacnggtgaacgaaagtaacgtaaccccggttcgaccgtttaggttactttaccgg

SEQ ID NO: 317847 - DNA, 535 bp, Homo sapiens
  misc_feature: GZ8MTXP02I2DWG.10.79.H02.1.454.CMB.2.raw
  modified_base (317)..(317): a, c, t, g, unknown or other
  misc_feature (317)..(317): n is a, c, g, or t
  modified_base (429)..(429): a, c, t, g, unknown or other
  misc_feature (429)..(429): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggtccncaggctccgagggagggctggagtgggttccagtacatttatcctagtgtgatacatatactagcagactctgtgaaggccgattcaccatctcaggacaacgcaaagactnactgactttgacaaatgaaacaccctgcgacgaccgaggacacggcctaatacttactgtcgaacgacgtaaactaacccggtcgtccttaggtttactttaaccg

SEQ ID NO: 317848 - DNA, 543 bp, Homo sapiens
  misc_feature: GZ8MTXP02F6KT2.10.79.H02.1.454.CMB.2.raw
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (449)..(449): a, c, t, g, unknown or other
  misc_feature (449)..(449): n is a, c, g, or t
tcagcatagtagtgcacgaccggtgctcgatttagtgtcacacgaagggaaaggggagctctgggagaagagccccagcccagaattcccaggagtttccattcggtgatcagcactgaacacagaggactcaccatggagtttgggctgagctgggtttccttgttgctattataaaaggtgtccagtgtcaggtgaagctggtggagtctgggggagcttggtcaagcctggagggtccctgagactctcctgtgcagcctntggattcgcctctggattgacgttcagtgactactacatgacctgggtccgccaggctccagggaaggggctggatgggtttcccatacatttancctagtggtgatacanatatagcanatctgtgaggacgatacacatctcacgacgaacgacaacaactacactacgtacttacgtacaanaacgaacaaccacgacgacgacgacgacgacggacgtacgtacttactacgtgcgacgaacgtaaaccgtaccgtaccgtacgttacgttaacg

SEQ ID NO: 317849 - DNA, 657 bp, Homo sapiens
  misc_feature: GZ8MTXP02FMM1T.10.79.H02.1.454.CMB.2.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactanatgacctgggccnccaggctccgaggggagggctgggagttggggtttccagttacatttatccgtagtggtnactaccattatactacgcagactctggtagaaagggcccgtaattcccgaacctactcctaccgaacggggaaccaaaccggacccaaaagaacccttcaaccttaggtaaccttttacggaacctaaaagttacgaaaccctaccccctaggaccggaacggaccggaaacgggaaccgaccgggtacccggttaattaacgttaacctggttacgaaccgtaaacggtaaaccttaacccccggttcgtacccgttacgggtttaactttaaccccg

SEQ ID NO: 317850 - DNA, 500 bp, Homo sapiens
  misc_feature: GZ8MTXP02JAWUB.10.79.H02.1.454.CMB.2.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggntcctcatctatggtacatctagcaggccactggcatcccagacnggtcagtgcagtggtctgggacagcttnactctcacatcagcagactgagtctgaagatttgcagtgtattatgtactagcaaatatggtagtcaactgggtactttggcaaggggtaccaaagctaggagatacaaaacgaactgtaggctgacaccatctagtcttac

SEQ ID NO: 317851 - DNA, 551 bp, Homo sapiens
  misc_feature: GZ8MTXP02G3D06.10.79.H02.1.454.CMB.2.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccacgtggcatcccagacaggttcagtcgcagtgggtctggggacngcttcactctcaccatcagcagactggagtctgaagtntttgctagtgttatttagttgtactagactaagttagtagggtagtcgtaccgttggggtacgttttgggaccgtagggggacctaaaggcgttagggacgtaagtacgaaaacgtactaggttggcgtagactaccattcgtcgttactttac

SEQ ID NO: 317852 - DNA, 514 bp, Homo sapiens
  misc_feature: GZ8MTXP02JBQO3.10.79.H02.1.454.CMB.2.raw
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggtccgcaggctcgagggagggctggagtggttcatactatttatctagtgtgataccatatactacgcagactctgtgaaggccattcacatcncaggacaacgcaaagactcactgacttgacaaatcgaacncctgcgacgcgaggacacggctatcgtacngtgcgaagtaactacccgtcgccgttaggttactaccg

SEQ ID NO: 317853 - DNA, 548 bp, Homo sapiens
  misc_feature: GZ8MTXP02GT7V5.10.79.H02.1.454.CMB.2.raw
  modified_base (321)..(321): a, c, t, g, unknown or other
  misc_feature (321)..(321): n is a, c, g, or t
  modified_base (470)..(470): a, c, t, g, unknown or other
  misc_feature (470)..(470): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctggggtcccnccaggcctccgaggggaggggctgggagttgggtttaccatactatttatccgtagtggtgataccatatactacgcagactctgtgaaggggccattcaccatctacgaggacaacgccaaagactcactgacttgacaaatcgaacnccctgacgagcgagacacggcgtatactacgtgtcgaacgaacgaacttacccggttcaccgtaggtttactttaccg

SEQ ID NO: 317854 - DNA, 592 bp, Homo sapiens
  misc_feature: GZ8MTXP02HDCC4.10.79.H02.1.454.CMB.2.raw
  modified_base (269)..(269): a, c, t, g, unknown or other
  misc_feature (269)..(269): n is a, c, g, or t
  modified_base (377)..(377): a, c, t, g, unknown or other
  misc_feature (377)..(377): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctcgnggattcgcctctggattgacgttcagtgactactacatcgaccgtgggtcccgcaggcctccgaggggacgggctggagttggttccatactatttactctagtggtnatacatatacctacgcagactcgtagtagagggccctattccaacctatccaccgaggaacaaacgacccaaagacctcgaactgtacttgaactaaatcgaaactcccgtgacgtacggaccgagggacccacggtaccgtaacttacttacgtacggtcgaacgtaaacgtaacttaaccccggttgaccctttaggttaactttaaccccgg

SEQ ID NO: 317855 - DNA, 610 bp, Homo sapiens
  misc_feature: GZ8MTXP02HB2K9.10.79.H02.1.454.CMB.2.raw
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcctgtagctattataaaggtgtccagtgtcaggtgaagctggtggagtcgtgggggagcttggtcaagcctggagggtcctgagactctcctgtgcagcctctggacttcgcctctggattcgacgttcagtgactactacatcgacccgtgggtccaccgaggcctccgaaggggaggggctaggggaggttgggttacccagtactatttactccgttaggtggttgacttaaccattactaaccgtacgcaagcccttgtaggtaggaaacggggcctaattccacccattccaccgaggacaaaccggccaaagtactcagtactacttgaactaaancgaaacccncctagacgacggaccggacggaccgacggtactaattacgtacgtgtacgaacgtaacgtaacccgttacccggtcgtacgtttacgtttacttaccg

SEQ ID NO: 317856 - DNA, 593 bp, Homo sapiens
  misc_feature: GZ8MTXP02J1LOW.10.79.H02.1.454.CMB.2.raw
  modified_base (373)..(373): a, c, t, g, unknown or other
  misc_feature (373)..(373): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcgttggtcaagcctgggagggtccctgagactctcctgtgcagcctctggtattcgcttcgtggattgacgttcagtgactactacatcgacctgggtcccgcgaggctccgaggggagggctgggagttgggtttccagtactatttanccgtagtggtgataccatatactacgcagactcgtgtaggaacgggccgtatcaccatccgtaccgagggaccaacgaccaaagacctcactgtacttgactaaatcgaaccncctgaccgacgacccggaggaccaccggggtacctaattacgttacgtgtcgaacgtaacgtaaacgttacccccggttcgtcccgtttaggtttactttaacccgg

SEQ ID NO: 317857 - DNA, 559 bp, Homo sapiens
  misc_feature: GZ8MTXP02F4H7R.10.79.H02.1.454.CMB.2.raw
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
  modified_base (467)..(467): a, c, t, g, unknown or other
  misc_feature (467)..(467): n is a, c, g, or t
tcagcatagtagtgcacgaccggtgctcgatttagtgtcacacgaagggaaaggggagctctgggagaagatccccagccccagaattcccaggagtttccattcggtgatcagcactgaacacagaggactcaccatggagtttgggctgagctgggttttcctgtgctattataaaggtgtccagtgtcaggtgaagctggtggagtctgggggagcttggtcaagcctggagggtccctgagactctcctgtgcagcctctggacttcgcctctggattgacgttcagtgactactacatgacctgggtccnccaggcctccgaggggagggctgggagtgggttccatacatttactctagtggtgatacatatactacgcagtactctgtgaagggccattccaccatccncgagggacaaacgccaaagactcgaactgtaactttgacaaatcgaaaccncccgtgaccgagaccggaggaccgaccggggtcctaatacttaccgtgtcgaacggataacgttacccgttcgaccttcggttactttaccg

SEQ ID NO: 317858 - DNA, 573 bp, Homo sapiens
  misc_feature: GZ8MTXP02FVJGY.10.79.H02.1.454.CMB.2.raw
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (523)..(523): a, c, t, g, unknown or other
  misc_feature (523)..(523): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtnactactacatgacctggggtcccnccgaggcctccggaggggaaggggctgggaggttggggtttccattactatttactcctaggttggtnataccattatactacgcagactctggtgaaggccattcaccatcnccgaggacaacgccaaagactcactagactttgactaaatcgaaaccaccctgacgacgaccggaggaccacggtccgtaatacttacgngtacgaacgtaacgaaccttacccgtcgtaccgttaggttactttaaccg

SEQ ID NO: 317859 - DNA, 745 bp, Homo sapiens
  misc_feature: GZ8MTXP02J2DKF.10.79.H02.1.454.CMB.2.raw
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtccagtgtcaggtgaagctggtggagtcgtgggggagcttggtcaagccgtggacgggtccctgagctctcctgtgcagccctnggattcgcctntggtatgacgttnagtgtactactactagtcgaccgtcggtcccgcgtacggccgtacggaggggacgggtcgtagggtacggttcggtttaccacgttactactttacgtccgttaggttacggtagtaactaacctaattaacgttaaccgtaacgactaacgtaccgttacgttacggtaacggggtaaacgggtacccgttaacttaccctaacccgtaccgttaacccgtaacccgggaaacggtaaaccccgaaaacccggtaaacccgtaaaaccggtaacctaccgtaaccgtttaccggttaactttacgaaccgtaaaaccgtaaccgtaaacccgtaacccgtaccggtaccgaaccggaccggaccggaaccggacccggtaccgtaacgttacgttacgttacgtacgtaacgtaacgtaaccgtacccgttaccgtaccgttacgttacgttacg

SEQ ID NO: 317860 - DNA, 666 bp, Homo sapiens
  misc_feature: GZ8MTXP02GVMI1.10.79.H02.1.454.CMB.2.raw
  modified_base (604)..(604): a, c, t, g, unknown or other
  misc_feature (604)..(604): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagtcttggtcaagccgtggagggtccctgagactctcctgtgcagcctctggacttcgcctcgtggattgacgttcagtgactactacagtcgacccgtggggtcccgccgacggcctcccggaagggggaacggggcgtaggggaggtttggggtttaccatacctatttactccgttagttcggtgtactaccattactactacgcagtacctgtggtagaacggggcctaattccgaccctattcccgtaccgaacggggaaccaaaccggaccaaaacggaaccttaccacgttacgtaacctttcgaaactaaaagtcgaaacctccccgtagacgacggaccgaaggaccgaccgggtaccgttattaacgttaccgnggttacgaacgtaacgtaaaccgttaaccccggttgtacccgtttgggtttaaactttcccg

SEQ ID NO: 317861 - DNA, 557 bp, Homo sapiens
  misc_feature: GZ8MTXP02GU2O8.10.79.H02.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtcttgacgcagtctccaggcaccctgtctttgtctccgaggggaaangccacgctctcctgcagggccagtcagagttcttagcagcaactacgttgcctggtaccaanagaaacctggaccaggcctcccgggctcctcatctatggtacatcagcagggccatggacatcccagacaggttcagtggcagtggtctgggacngtcttcactctcacatcagcagactggagtctagtaagtnttttagctaagttgtatttagtgtacagtactaattagtaggtaagtcttacggtcggttacgtttgggaccgtaagggggacctaggtacgtagggaacgtagtaccgaaaacgtacgtaggtacgaacgttcgactacctatccgttcttactttac

SEQ ID NO: 317862 - DNA, 601 bp, Homo sapiens
  misc_feature: GZ8MTXP02HVYTW.10.79.H02.1.454.CMB.2.raw
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgtttgctattataaaggtgtccagtgtcaggtgaagctggtggagtcgtgggggaggtcttgggtcaagcctgggagggtccctgagactctcctgtgcagcctctggacttcgcctctggattgacgttnagtgactactacatcgacctgggtcccncgaggcctccgaggggagggctggagtggtttccagttactatttactctagtgtgactacatactactacgcagctcgtgtagacgggccgattcaccctatccaccgaggaccaaacgccaaagaacctcactagtaccttagaacctaaatcgaaacctacccgtagacgaacggaccggacggaaccgacgggtaccttaagttacttacgtggtacgaacggtaacgtaaaccgttaacccggttcgtacccgtttaggtttaactttaccg

SEQ ID NO: 317863 - DNA, 625 bp, Homo sapiens
  misc_feature: GZ8MTXP02GRT8S.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggaggtccctgagactctcctgtgcagcctctggattccgcctcgtggattgacgttcagtgactactacatcgaccgtgggtcccgccgaggcctccggaggggacggggctgggaggttgggttaccatactatttactccgtaggtggtgtactaccatactactacgcagacctcgtgtagaacggggcctaagttccaacctactcccgtaccgaacggggaaccaaaccgacccaaaagaacctcaacgttagtacctttagaactaaatcgaaacctcccgtgacgacgacccggaggaccgaccggaccgtaattacgttacgtggtacgaacgaacgtaaaccgtaccccgtcgtaccgtttacggtttactttacccg

SEQ ID NO: 317864 - DNA, 545 bp, Homo sapiens
  misc_feature: GZ8MTXP02HI49V.10.79.H02.1.454.CMB.2.raw
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggattcgcctctggattgacgttcagtgactactacatgacctgggtccgccaggcctccgagggagggctgggagttggttccatacatttatctagtggtgataccatatactacgcagactctgtagaaggcattcaccatcncgaggacaacgccaaagactacactgtacttgacaaatcgaaacnccctgacgacgccgacggacaccggacgtaatacttactgtagaacgagtaaactacccgtcgtacccttggtttaactttaccg

SEQ ID NO: 317865 - DNA, 703 bp, Homo sapiens
  misc_feature: GZ8MTXP02IMZ5H.10.79.H02.1.454.CMB.2.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggaggtccctgagactctcctgtgcngcctntggatcgctctgattgacgttcagtgactactacatcgaccgtcgggtcccgccgaaggcctaccggaaggggaacggggtcgtgggaggttgggtttaccattactatttactcgttaggtggtgtaactacctattactacctacgctaagacttcgtaggtaggaaacggggccctaaagtttcccaaccctagttcccgtacccggacggggaaacccaaaccgggacccaaaaggtaaacccttcgaaccgtttggtaaaccctttggaaaccctaaaagttccgaaaaccctacccgtggaccgacggaccgggaacggaaccgaccggtaaccggttattaaacgttacgttacggtacgaaccggaaacgttaaaacccgtttaaacccccggttcgtacccgttttagggttttaacctttaacccgg

SEQ ID NO: 317866 - DNA, 591 bp, Homo sapiens
  misc_feature: GZ8MTXP02JLPEJ.10.79.H02.1.454.CMB.2.raw
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgacgactctcctgtgcagcctctggacttcgcctntggattgacgttcagtgactactacatgacctgggtccnccaggctcgagggagggctggagtggttccatacatttanctagtgtgatacattanactacgcagtactctagtgaacggggccacttcaccattcctaccggaggggaaccaaacggccaaagacttaccacctggtaacctttgactaaaagtcgtaaaccacccgtagcgaacgcccggaaggaccaccggggccttagtacttaacgtggtacaacggtagtaaaccttacccggttacgtccgttacggtttaactttacccgg

SEQ ID NO: 317867 - DNA, 536 bp, Homo sapiens
  misc_feature: GZ8MTXP02JZ8FI.10.79.H02.1.454.CMB.2.raw
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
  modified_base (460)..(460): a, c, t, g, unknown or other
  misc_feature (460)..(460): n is a, c, g, or t
  modified_base (477)..(477): a, c, t, g, unknown or other
  misc_feature (477)..(477): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatcgacctggtcccgccaggctccgaggggagggctgggagtgggttccatacatttacnctagtgtgataccatatactacgcagactctgtgaagggccattcaccatcnccgaggacacgcaagactcactgtactttgacaaatcgaacnccctgcgagccgagacnccggactactatacgtgtcgcgtaagaactaccccgtcgaccgttaggttactttaccg

SEQ ID NO: 317868 - DNA, 864 bp, Homo sapiens
  misc_feature: GZ8MTXP02I68RD.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagtcgttggtcaagccgtgggacgggtccctgagctctcctgtgcagcctcgtggactcgcctcgtggattgacgttcagtgaacttactacatcgaccgtcggggtccccgccgagggtccctaccggaagggggtaaacgggggcgttggggtaagggtttcggggtttaccccaagttaccgttaagtttttaaccgtcccgttaaggggttcgggttagtaaacttaacccgtaaatttacgttaaccgtaaccgggactaaacggtaacccttcggttaggtacgggaaaaccgggggtccccttaaagtttaccccaaacccgtaacgtttccccgtaacccgggaaacgggggaaacccctaaaacccgggacccccaaaaaaggtaaccccgttaccctaaacccggtttacgggttaaacccttttacgggaaaaaccttaaaaaaccgtttaaaacccccgcccccggttaaggaccccgggaaaacggcccccggaaaaaggggacccgtaaacccggggtacccgttaaattaaaccggtttacgtacgggtacgtaaccggtaaaggtaaaacccctttaacccccgggtttcgacccgttttaacggtttaaacctttaacccgttacgg

SEQ ID NO: 317869 - DNA, 592 bp, Homo sapiens
  misc_feature: GZ8MTXP02FW5XH.10.79.H02.1.454.CMB.2.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccacgctctcctgcagggccagtcagagtcttagcagcaactacgttgcctggtaccaanagaaacctggccaggctcccggctcctcatctatggtacatcagcaggccacgtggcactccccagtaccgaggttcaaggtcggactaggtggggtctaggggaactaggtaccctttcaccttcctacaaccctatccagcaacgtacgtggacgttctaggtaaagttagttttgacgtaagttagttatttagttgtactagactaagtagtggtaggtctaccggtggttacgtttggaccggtagggacctaaggcgtaggtagataacgaaaacgacgttagtcgctaggaacctacgtacttctcgttactttccactttcccg

SEQ ID NO: 317870 - DNA, 626 bp, Homo sapiens
  misc_feature: GZ8MTXP02JX5C8.10.79.H02.1.454.CMB.2.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtctagcagcaactcgttgcctggtaccaacagaaacctggaccaggcctcccgggctcctcatctagtggtacatctagcaggccagtggcactcccagacgtaggttcaggtcggacgtaggttcgggtctaggggacagtccttcacttcctacaacctatcgagcaagtactagggagtacgtagtaagttagttttgacgttagttagttaatttattggtactagactaagttaggttaggtaggttacccgtacgggttacggggttacgttttacggggaccgggtaaagggggaaccctaaggtacccggttagggaacgtaaacgtaaccgaaaacggtacgttaggtacggaactacggacctacgtactccgttagtcctttacc

SEQ ID NO: 317871 - DNA, 749 bp, Homo sapiens
  misc_feature: GZ8MTXP02I7CP1.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtggggggaggtcttggtcaagccgtgggacgggtccctgagactctcctgtgcagcctcgtggacttcgcctcgtggattgacgttcagtgaactactacatcgaccgtgggtcccgccgaggtccctccggaagggggaacggggctagggaggtttgggtttacccaataccgttattttacgtccgttaaggttggtgtaactaacctaagttaactaaccgtacgacaagtaccttcgtaggtacggaaacggggtcctaagttccaacccgtattccccgtaaccggaaacggggaaaccaaaacccggtacccgaaaaacgtaaaccccttctaaacccgttacgttaacgtttagaaacctaaaagttaccgaaaccctacccgtaggacccgaaaccggacccggaagggaacccgtaaacccggggtacccgttaaagttaccgtttaacgtcggttacgaacggtaaacgtaaacccgtttacccccggttaccgtaccggtttacggtttaacctttacccgg

SEQ ID NO: 317872 - DNA, 645 bp, Homo sapiens
  misc_feature: GZ8MTXP02JDDUY.10.79.H02.1.454.CMB.2.raw
  modified_base (277)..(277): a, c, t, g, unknown or other
  misc_feature (277)..(277): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgtgctattataaaaggtgtccagtgtcaggtgaagctggtggagtcgtgggggagcttggtcaagcctggagggtccctgagactctcctgtgcagcctctggattcgcctntggattgacgttcagtgactactacatcgaccgtggggtcccgccgaggccctccgaagggggacgggctgggaggttgggtttaccagtactatttactccgtaggtggtgaactaccatactactacgcaagtactcgtggtaggaacggggccctaagttccaccctatccctaccgaacggggaaccaaccggaccaaagaaccttcgaaccttgtaacctttgaaccaaagtaccgaaacctacccgtagacgaacggacccggaagggaccaccgggtaccgttaattacttaaccgtggtacgaacggtaacgtaaaccgttaacccggttcgtaccgtttacggtttaactttaacccgg

SEQ ID NO: 317873 - DNA, 572 bp, Homo sapiens
  misc_feature: GZ8MTXP02HEZCT.10.79.H02.1.454.CMB.2.raw
  modified_base (319)..(319): a, c, t, g, unknown or other
  misc_feature (319)..(319): n is a, c, g, or t
  modified_base (515)..(515): a, c, t, g, unknown or other
  misc_feature (515)..(515): n is a, c, g, or t
  modified_base (534)..(534): a, c, t, g, unknown or other
  misc_feature (534)..(534): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggattcgcctctggattgacgttcagtgactactacatgacctgggtccnccgaggcctccgaggggacggggctgggaggttgggttccagttactatttactccgtagtgggtgtactaccatatactacgcagactctgtgaacggggcctaattcgaccatccgtacgacgggaccaaaccggccaaagacctcacgttgactttcgacaaaatcgaaaccaccctgaccgagaccgagacncggtaccgtattacgtacngtacgcgaagaacctaccgtcgcttcggttacttaccg

SEQ ID NO: 317874 - DNA, 541 bp, Homo sapiens
  misc_feature: GZ8MTXP02H858H.10.79.H02.1.454.CMB.2.raw
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctntggattcgctctggattgacgttcagtcgactactacatcgaccctggggtccnccgaggctccgaggggaggggctgggagttgggttccatactatttanctagtggtgatacatactactacgnagactngtagaggccattcaccatccncgaggacacgcaaagactnaactcgacttgactaatcgaaccaccgtgacgacgccgaggacncggaccgtatactactgcgaacgtanaactacccggttcaccgttggttactttaccg

SEQ ID NO: 317875 - DNA, 586 bp, Homo sapiens
  misc_feature: GZ8MTXP02ILM8R.10.79.H02.1.454.CMB.2.raw
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtctgggggagcttggtcaagcctggagggtccctgagactctcctgtgcagcctntggacttcgcctntggattgacgttcagtgactactacatgacctgggtccnccaggctcgagggagggctggagtgggttcatacatttatccgtagtgtnactaccatactactagcagactctggtagacggggcctagttacaccctatcctaccgaaggggaaccaaaccggacccaaaagaacctcactcgtaacctttgaacctaaagtcgaaaacctccccgtagccgaacgcccggaaggaccaccgggtaccgtatacgttactcggtgaacgaacgtaaacgtaccccgttgacctttggttaactttacg

SEQ ID NO: 317876 - DNA, 683 bp, Homo sapiens
  misc_feature: GZ8MTXP02GFU11.10.79.H02.1.454.CMB.2.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagtcttggtcaagcctgggagggtccctgagactctcctgngcagcctntggattccgccttntggtattgacgttcagtgactactacatcgaccgtgggtcccncgaggcctccggaggggaaggggctgggtagttgggtttaccatactatttactcgtagttggtgactacctatacgtactacgcagtactcgtaggtaggaacggggtccgtattaccacctacttacccgtaccgaacggggaacccaaacccgggaccaaacggtaaccctaccgtaacgttacggtaacctttacgaactaaaagttaccgaaaccaccccgtacggaccgacgacccggaacggaaccgaccggggtaccgttaacgttaacgttaccgttggtacgaaccgtaaacggtaaaccgtttaacccccggttaccgttacctttacgggtttaacttttaaccgg

SEQ ID NO: 317877 - DNA, 600 bp, Homo sapiens
  misc_feature: GZ8MTXP02JPIOK.10.79.H02.1.454.CMB.2.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (381)..(381): a, c, t, g, unknown or other
  misc_feature (381)..(381): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtcagtgtcaggtgaagctggtggagtcgtgggggaggcttggtcaagcctgggagggtccctgagactctcctgtgcagcctctggattcgcctntggtnttgtactnagtgactactactagtcgaccgtcggccgcgacggcgtaccggaggggacgggtcgtgggaggttggttcatactatttactcgtagtggtntactacatactactacgacagtctgtagtacggaacggtcctatcacctctccgtacgaggaacaaccgacaaagtacctnactgtacttanactaaagtacgaacctccgtagccgaacgccggtaaacggaccgaccggtacttactacgttaccgtgtacggtaacgtaaacgtaaaccgttaccccggttacgtccgtttacgtttaacttaccg

SEQ ID NO: 317878 - DNA, 703 bp, Homo sapiens
  misc_feature: GZ8MTXP02GWR0E.10.79.H02.1.454.CMB.2.raw
  modified_base (651)..(651): a, c, t, g, unknown or other
  misc_feature (651)..(651): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttttgtgctattataaaggtgtccagtgtcaggtgaagctggtggagtcgtgggggaggcttgggtcaagccgtgggacgggtccctgagactctcctgtgcagcctctggattcgcctctggattgacgttcagtgactactacatcgaccgtgggtccgccgaggccctccggaagggggaacggggctaggggacggtttggggtttacccaagttacctaatttttacgtcccgttaagggttgggttgaacttacccaattaactaccgtaacggactaggaccttcgtggttacggaaacgggggtccctaatttaccgaaccctattcccgtacccgaaacgggggaacccaaaaccggacccaaaaggtaacccttaccaaccgttagtaacccgttttagaacctaaaacgttacgaaacccaccccgtaggaccgaacggacccggaaggaccaaccggggtacctaatacgttacnggtagaacgaacgtaaaccttacccggttcgaccttaggtttactttacccg

SEQ ID NO: 317879 - DNA, 567 bp, Homo sapiens
  misc_feature: GZ8MTXP02GIIVY.10.79.H02.1.454.CMB.2.raw
  modified_base (318)..(318): a, c, t, g, unknown or other
  misc_feature (318)..(318): n is a, c, g, or t
  modified_base (516)..(516): a, c, t, g, unknown or other
  misc_feature (516)..(516): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggagggtccctgagactctcctgtgcagcctctggattcgcctctggattgacgttcagtgactactacatcgacctgggtccnccaggcctccgaggggaggctggagttgggttaccatactatttactccgtagttggtgataacctatactactacgcagtactctaggtagaacgggcctattccacctatccacgaggaccaaacgccaaagactcatgtacttagacaatcgaaacctccgtagcgacgccgaggacacgggactaatacttacnggtacgaacgaagtaaaccttacccggtcgaccgtttaggtttacttaccg

SEQ ID NO: 317880 - DNA, 604 bp, Homo sapiens
  misc_feature: GZ8MTXP02IYYBI.10.79.H02.1.454.CMB.2.raw
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (494)..(494): a, c, t, g, unknown or other
  misc_feature (494)..(494): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctgggtggagtcgtgggggagcttggtcaagcctgggaggtccctgagactctctgtgcagcctctggattcgcctctggattgaccgttcagtgactactacatcgaccgtggggtcccnccaggcctccgaggggacggggctgggagttgggtttccagtacctatttacnccgtaggttggtgataccatactactacgctagactcgtgtggaaacgggccaattccaccatcctaccgagggaccaaacgccaaagaccttcactgtaccttgactaaatcgaaaccncccgtgaccgacgtacccggaggaccgaccggtaccgttaattacgtaacgtgtacgaaccgaacgtaaacgttaaccccggttcgtaccgtttaggtttaactttaccg

SEQ ID NO: 317881 - DNA, 543 bp, Homo sapiens
  misc_feature: GZ8MTXP02FTEFD.10.79.H02.1.454.CMB.2.raw
  modified_base (197)..(197): a, c, t, g, unknown or other
  misc_feature (197)..(197): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagcatagtagtgcacgaccggtgctcgatttagtgtcacacgaagggaaagggggctgctcagttaggacccagagggaaccatggaaaccccagcgcagcttctcttcctcctgctactctggctcccagataccaccggagaaattgtgttgacgcagtctccaggcaccctgtctttgtctccaggggaaangccatgctctcctgcagggccagtcagagtctagcagcaactcgttgcctggtaccaacagaaacctggccaggcctcccgggctcctcatctatggtacatctagcagggccatggcatcccagacagtcagtgcagtggctgggacagacttnactctcaccntcagcagctggatctgaagtntttgctagttgttattnttgtacagactaatagttagggtagtacgtaacgtgggttaactttgggacccgtaaggggaccaaaggtctagggaagtactaacgaaaacgtacgtgtacggtactaaggacaaccgtatcctacgttaccttacttaccg

SEQ ID NO: 317882 - DNA, 583 bp, Homo sapiens
  misc_feature: GZ8MTXP02G4Y1W.10.79.H02.1.454.CMB.2.raw
  modified_base (200)..(200): a, c, t, g, unknown or other
  misc_feature (200)..(200): n is a, c, g, or t
  modified_base (384)..(384): a, c, t, g, unknown or other
  misc_feature (384)..(384): n is a, c, g, or t
  modified_base (436)..(436): a, c, t, g, unknown or other
  misc_feature (436)..(436): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaanagccagctctcctgcagggccagtcagagtcttagcagctaactacgttgcctaggtaccaacagaaacctggccaggctcccgggctcctcatctatggtacatctagcaggccactggcactcccgagacaggttcaggtgcaggtgggtctggggacaggtccttcactctacaccatcancagacgtggagtctgtaagtatttgactagttagttatttacttgtacagtntaaagttgtaggttacggtctacggttgggttacgtttcggacgtaacggggaccctaaggtcgtagggacgtaacgttaacgaaaaccggtaacgtacgggttagcgttcgaccgtaccctaggttcttacggtttcctttaaccg

SEQ ID NO: 317883 - DNA, 534 bp, Homo sapiens
  misc_feature: GZ8MTXP02F33J2.10.79.H02.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccacgctctcctgcagggccagtcagngtcttagcagcaactacgttgcctggtaccaacagaaacctggccaggcctcccgggctcctcatctatggtacatctagcagggccatggcatcccgagaccnggttcaggtcggacagtgggtcnggggacagtctcactctcacctatcagccagactggagtctagaatgttttgctagttgttattagttgtcaagtcaaattagtaggtagtctacgtgggttactttgggacgtagggaaccagtcgtaggacatacgaaaacgtacgtgtacggctgactaccgattctacgttcttac

SEQ ID NO: 317884 - DNA, 604 bp, Homo sapiens
  misc_feature: GZ8MTXP02JP9YL.10.79.H02.1.454.CMB.2.raw
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (433)..(433): a, c, t, g, unknown or other
  misc_feature (433)..(433): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctntggattgacgttcagtgactactacatgacctgggtccncaggcctccgaggggagggctgggagtgggttccatactatttactcctaggtggtgactaccatactactacgcaagtactctgtacggaaggggcccattcacccattccnccgagggaccaacggccaaagactcgactgaacctttgaccaaagtcgaaccnccctaggaccgacggacccggaggaaccgaccggggtaccttaattaacttacccgtgtacggaaccggaagtaaaaccgttaccccggttcgaccctttagggtttaactttacccg

SEQ ID NO: 317885 - DNA, 574 bp, Homo sapiens
  misc_feature: GZ8MTXP02GJLYM.10.79.H02.1.454.CMB.2.raw
  modified_base (318)..(318): a, c, t, g, unknown or other
  misc_feature (318)..(318): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctgggtggagtcgtgggggagcttggtcaagcctgggagggtccctgagctctcctgtgcagcctctggattcgcctctggattgacgttcagtgactactacatgacctgggtccncaggctccgagggagggctggatttgggttccatactatttactcctagttggtgactaccattactactacgcagactcgtgtagagggccgattcacctatcctaccgaggaccaaccgaccaaagaacctcgactcgtactttagactaaagtcgaaccaccgtgacgacgccgacggacaccggacgtactactacgtgtacgaacgaacgtaacgttaaccccggttcgaccgttacggtttactttaccg

SEQ ID NO: 317886 - DNA, 538 bp, Homo sapiens
  misc_feature: GZ8MTXP02H41H6.10.79.H02.1.454.CMB.2.raw
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggatgacgttcagtgactactacatgacctgggtccncaggctccgagggagggctggagtggttcatactattatctagtggtgataccatatactacgnagactcngtgaaggccattcacntcncaggacaacgccaaagactnactgacttgacaaatgaaacaccctgacgacgaccgaggaccacggaccgtatacgtaacgtgtacgaacgagaaaacttaaccccggtcgaccgtttggtttaacttaccg

SEQ ID NO: 317887 - DNA, 659 bp, Homo sapiens
  misc_feature: GZ8MTXP02FNWHJ.10.79.H02.1.454.CMB.2.raw
  modified_base (550)..(550): a, c, t, g, unknown or other
  misc_feature (550)..(550): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggtcgttggtcaagccgtgggacgggtccctgacgactctcctgtgcagcctctggattcgcctcgtggattgacgttcagtgactactacatcgaccgtgggtcccgcgaggcctccggaagggggaacgggctggggagttgggtttacccattactattttacgtccgttaggttgggtgacttaacctattaacttacctacgcaagtaccttcgtaggtaggaaacggggtccctaagttccaaccctattcccgtacgaacggggaaccaaaccggacccaaaagaacctcacttacggtaactttgaactaaatcgaaaccncccctggaccgacggaccggaggaccacgggtacctaattaccgtacgtgtacgaacgtaacgtaaaccgttaccccggttcgtacctttagggtttaactttaacccg

SEQ ID NO: 317888 - DNA, 668 bp, Homo sapiens
  misc_feature: GZ8MTXP02GA55Z.10.79.H02.1.454.CMB.2.raw
  modified_base (329)..(329): a, c, t, g, unknown or other
  misc_feature (329)..(329): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagtcttggtcaagccgtgggagggtccctgagactctcctgtgcagcctcgtggacttccgcctcgtggattggacgttcagtgactactacatcgaccgtgggtcccncgaggcctccggaaggggacgggtctgggaggttgggtttacccagttactattttactccgttaggttcggtgaactaccgattactaccgtacgcaagtaccttcgtaggtacggaaacgggtcctaattccacctatcccgtacgaagggaccaaaccgaccaaaggacccttacacttagtaactttacgaactaaaagtcgaaaaccctcccgtaggaccgacggaccggacggaacccgtaccgggtaccttattacgttacgtggtacggaaccgtaaacgtaaaccctttaccccgggttctacccggtttaaggtttacctttaacccgg

SEQ ID NO: 317889 - DNA, 682 bp, Homo sapiens
  misc_feature: GZ8MTXP02GI678.10.79.H02.1.454.CMB.2.raw
  modified_base (286)..(286): a, c, t, g, unknown or other
  misc_feature (286)..(286): n is a, c, g, or t
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtggggggagcttggtcaagccgtgggacgggtccctgagactctcctgtgcagcctcgtggacttcgcctntggattgacgttcagtcgactactacatcggacctggggtcccgcaggcctccggaagggggaacggggtctaggggaggttcggggtttaccagttacctattttactccgtaggttggngtactacccattatactacggcacgtacttntggagaacggggccctaattccgaccagtctacccgaaggggaccaaaaccggcccgaaaagtaccctactaaccgttacgtaacgttttcgaaacctaaaagtcggaaaaccacccgttacggaccgaacggacccgggaacggaaccgaaccgggtacccgttaaagttacttaacgcggtcgtaacggaacgtaaaccttaaaccccgggttcgacccgtttagggtttaactttacccgg

SEQ ID NO: 317890 - DNA, 877 bp, Homo sapiens
  misc_feature: GZ8MTXP02JFV4F.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagcctctggacttcgcctctggtattgacgttcagtgactactacatcgaccgtcgggtccgccgacgggcctaccggaagggggaacggggtcgtaggggtaacgggtttcggggttttaccccaagttaaccgttaatttttacttcccgttaaaggttcgggttaggtaaactaacccgtaaattaacgtaacccttaacgactaaacgtacccttcgtaggtacggtaaacgggggcccgtaaacttccaaccctaatcccgtacccgaaacgggggaacccaaaacccgggaacccaaaacgggtaaacccttacccgtaaaccgttaccggttaaacctttttacggaacccgttaaaaattacccgggaaaaacccctacccccgttaacggggaccccggtaaaacgggacccccgggaaaacggggttaacccaaacccccggggggttaaacctttaaacggtttaaccgttttaaaaccgggtccgggtttaccgggaaaaccgggtaaaacgggtttaaaaaaccccgtttaaacccccccggggtttaccggtaacccccggtttttaagggggttttaaaccctttttaaacccccggg

SEQ ID NO: 317891 - DNA, 683 bp, Homo sapiens
  misc_feature: GZ8MTXP02HH364.10.79.H02.1.454.CMB.2.raw
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctgagactctcctgtgcagcctctggattccgcctctaggtattgacgttcagtgactactacatcgaccgtgggtcccnccgaggcctccggaggggacgggctgggaggttgggtttccatactatttatccgttaggtggtgacttacctagttactactacgctagtactcgtaggtagaacggggtccctaattcccaccctattcccgtaccggaaggggaaccaaacccggacccaaaaggtaacccttcgaacttcggttaacctttgaacctaaaactcggaaaccaccccgtaggacccgacggaacccggacgggaacccaaccggggtacccttaaatttaccgttaaccgtggtaccgaacggtaaacgttaaaacccttacccccggggtttctaccccgtttaagggtttaaccctttaccgg

SEQ ID NO: 317892 - DNA, 692 bp, Homo sapiens
  misc_feature: GZ8MTXP02G0XMN.10.79.H02.1.454.CMB.2.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagtcttggtcaagccgtgggagggtccctgagactctcctgtgcagcctctggattcgcctcgtggattgacgttcagtgactactacntcgaccgtgggcccnccgaggcctaccggaggggaagggctgggaggttgggttccattactatttacgtccgttaaggtggtgacttaaccaagttactaacctacggcaaggtaccttcgtaggtacgggaaacggggtcccgtatttacccaaccctacgtccctacccggaacggggaaccaaaccgacccgaaaagtaccctaccgaacgttcgtaactttacgactaaaacgtacgaaacccaccgtagaccgacgaccggacgggaaccgtaccgggtaccgttaacgttacgttaaccgtggttacggaaccgtaaacgtaaaaccgtttaacccccggttccgtaccgtttacggggtttaaccttttacccg

SEQ ID NO: 317893 - DNA, 720 bp, Homo sapiens
  misc_feature: GZ8MTXP02F37ZB.10.79.H02.1.454.CMB.2.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagcgttggtcaagccgtgggacgggtccctgagactctcctgtgcncgtcctgtgtctccgcctgtgtnttcgtacgtcgtagtacgtactaactactagtccggtaccggtccgggtcccgaccggacggtcccgtaccggggaaggggggtacgggtcggtaggggtacgggtttcgggtttaccctaacgttactttagtttaccgttacgttaggttgggtacgtaacctaacgttaattaacctaccgtacgacgtacgtaccctggtaggtaacgggaccggtacctacttacccacttacgttacccgaccgggaaacggaacccaaacccgaccgtaaacgtaccctacgtacgttacgttaacttaccgaaataacgtaccaaccctccgagacgaccggacggacgaccgtaccggtacttacgtacgtacgtcggtacgaacgtaaactaacccgtttacccgcgttacgtttacgttactttaccgg

SEQ ID NO: 317894 - DNA, 563 bp, Homo sapiens
  misc_feature: GZ8MTXP02GIV85.10.79.H02.1.454.CMB.2.raw
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
  modified_base (489)..(489): a, c, t, g, unknown or other
  misc_feature (489)..(489): n is a, c, g, or t
  modified_base (521)..(521): a, c, t, g, unknown or other
  misc_feature (521)..(521): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggagggtccctgagactctcctgtgcagcctctggattcgcctctggattgacgttcagtgactactacattgaccgtggggtcccnccgaggcctccgaggggaaggggctggggagttgggtttccagtactatttacnctaggtggtgatacatatactacgcagactctggtgaaggggccctattccacctatcaccgaggggaccaaacgccaaagaacctcactgtacttagacaaatcgaaacncctgcgagccgagaccacggctatactactgngaacgacgtaactacccgttacgcctttaggttactttaccg

SEQ ID NO: 317895 - DNA, 696 bp, Homo sapiens
  misc_feature: GZ8MTXP02GJCD0.10.79.H02.1.454.CMB.2.raw
  modified_base (575)..(575): a, c, t, g, unknown or other
  misc_feature (575)..(575): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggaggcgttggtcaagccgtgggacggtccctgagactctcctgtcgcagcctctggacttcgcctcgtggtattgacgttcagtgacctactacatcgaccgtcgggtcccgccgaggccgtccggaagggggtaacggggcgtaggggaggtttgggtttaccagttactattttactccgtaggttggtgtaactaacctattaactacgtacgactaagaccttgtaggtagggaaacggtcctaattaccaaccctagttccctaacccgggaaaggggaaacccaaaaccggacccaaaaggaacccttccaacgttcgttaactttacgaactaaaatccgaaaccncccgtaggacccgagacccgggaacggaaccgaccgggttaaccttaattaacgttacgtgggtacgaacgtaacgtaaaccgtttaccccgtggtaccctttaggtttaactttacccgg

SEQ ID NO: 317896 - DNA, 594 bp, Homo sapiens
  misc_feature: GZ8MTXP02G5OFI.10.79.H02.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcctgtagctatataaaggtgtccagtgtcaggtgaagctgggtggagtcgtggggggaggcttgggtcaaggccgtgggacgggtccctgagctctcctgtncagcctntggattccgcctgnggtattgacgttcagtnactactacatcgccgtggcccgccgaggtcctccggaggggacgggctggggagttgggttaccatactatttacgtcgtagtgggtnactacattatacacgnactctgtggagacggctactacaccntccgacgacgaacaaccgactaaagacctacacgtactacttacaactaaactaccgaacctaccgtagacgacggtaccggacgtaccgaccggtactattacgttacgtggtacgaacgtaacgtaaccgttacccgtacgtacgtttacgtttacttacg

SEQ ID NO: 317897 - DNA, 842 bp, Homo sapiens
  misc_feature: GZ8MTXP02GRF86.10.79.H02.1.454.CMB.2.raw
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggagtcttggtcaagccgtgggagggtccctgagactctcctgtgcngcctntggcttcgctntggattgacgttcagtgactactacatcgaccgtcgggtcccnccgagggcctaccggaagggggaacggggtcgtaggggtacggtttcggggtttacccaagttaaccgttaagtttttaccgtaccgtttaaggggttgggttagtaaaccttaaacccgtaattaacgttaacccgttaacggacctaacgtaaccttcgttaaggggttacgggaaaaccgggggtcccttaaacgtttccccaacccgttaacttaccccgtaacccgggaaacgggggaaaccccaaaacccggaaaccccgtaaaaacggtaaccctttacccgaaaccgtttacgggttaaaccctttacggaaaccttaaaacgttaccgaaaacccccgacccgttagggacccgggtaaccggacccggtaaacgggaacccgaccggggttaaccctttaaacgttaacgtttaaccgtgggtacggaaaccgtaaacggttaaaaccccgtttaacccccgggttccgtaaccgttttacgggttttaaaccctttaaccccgg

SEQ ID NO: 317898 - DNA, 551 bp, Homo sapiens
  misc_feature: GZ8MTXP02I7YGK.10.79.H02.1.454.CMB.2.raw
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (508)..(508): a, c, t, g, unknown or other
  misc_feature (508)..(508): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaaggcctgggagggtccctgagactctcctgtgcagcctctggatcgcctctggattgacgttcagtgactactacatgacctgggtccncgaggcctcgagggaggctggagtggttcatactatttacnctagngtgatacatatactacgcagactctggtgaacgggcctattcacctatcctaccgagggacaacgaccaaagaacctcactgactttgacaaatcgaacacccgtgacgacgaccggagaccacgggacctatacttacgtgngaacgagtaaccgtacccgttgcccgtttaggttactttaccg

SEQ ID NO: 317899 - DNA, 727 bp, Homo sapiens
  misc_feature: GZ8MTXP02JLSW5.10.79.H02.1.454.CMB.2.raw
  modified_base (271)..(271): a, c, t, g, unknown or other
  misc_feature (271)..(271): n is a, c, g, or t
  modified_base (657)..(657): a, c, t, g, unknown or other
  misc_feature (657)..(657): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttgggtcaaggcctgggacgggtccctgagactctcctgtgcagcctntggacttcgcctctggattgacgttcagtgactactacatcgaccgtgggtccgccgaggccctaccggaggggacggggctaggggaggtttggggtttaccattacgtattttactccgttaggtggttgacttaacctattaactaaccgtaccggactaacgtaaccttcgttaggtacggaaacgggggccctaagtttcccaaccccgtattaccccgtacccgaaagggggaacccaaaccggacccgaaaaggaacccttaccgaacgttaggtaaccttttaggacctaaaattcggaaaaccctacccgttacggaccgacggaacccggaacgggaacccgtaaccggggtacccgttaaattacgtttaaccgnggttacggaaccgtaacgtaaaaccgttaccccgggtttcgacccgtttagggtttaacctttaacccgg

SEQ ID NO: 317900 - DNA, 570 bp, Homo sapiens
  misc_feature: GZ8MTXP02I367W.10.79.H02.1.454.CMB.2.raw
  modified_base (280)..(280): a, c, t, g, unknown or other
  misc_feature (280)..(280): n is a, c, g, or t
  modified_base (323)..(323): a, c, t, g, unknown or other
  misc_feature (323)..(323): n is a, c, g, or t
  modified_base (479)..(479): a, c, t, g, unknown or other
  misc_feature (479)..(479): n is a, c, g, or t
  modified_base (520)..(520): a, c, t, g, unknown or other
  misc_feature (520)..(520): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgtgctattataaaggtgtccagtgtcaggtgaagctggtggagtcgtgggggagcttggtcaagccgtgggagggtccctgagactctcctgtgcagcctctggacttcgcctntggattggacgttcagtcgaactactacatggacctgggtccncaggcctcgagggagggctggagtgggttccatactatttactcgtagtggtgactaccatatactacgcagtacctgtggtagaacgggcctaagttccacctagtctaccgaggacaaccggacaagaactcactgacttgacaaatcgaaacncctgacgagcccgaggaccgacgggtacctatacgttaacnggtacgaacgaaagtaactaccccggtctaccgtttaggttacttaaccg

SEQ ID NO: 317901 - DNA, 590 bp, Homo sapiens
  misc_feature: GZ8MTXP02HFBNS.10.79.H02.1.454.CMB.2.raw
  modified_base (479)..(479): a, c, t, g, unknown or other
  misc_feature (479)..(479): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccgccaggcctccgaggggaggggctgggaggttggggtttccatactatttactccgtaggtggtgattaccattactactacgcagactctggtagagggccatcacatctcagggacaacgccaaagactacgactcgtactttagaccaaatcgaaaccnccctgacgacggacccgtaagggaccaccgggtcctaacgtacgttacgtgtacggaacgaaacgtaaccgttaaccccggttcgtacccgttacggtttactttacccgg

SEQ ID NO: 317902 - DNA, 736 bp, Homo sapiens
  misc_feature: GZ8MTXP02ITG2C.10.79.H02.1.454.CMB.2.raw
  modified_base (627)..(627): a, c, t, g, unknown or other
  misc_feature (627)..(627): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggttttccttgttgctattaataaaggtgtccagtgtcaggtgaagctggtggagtcgtgggggaggtcgttggtcaagccgtgggacgggtccctgagactctcctgtgcacgcctgtggattccgcctcgtggtattgtacgttcagtcgaactactacatcgaccgtcgggtcccgccgaggccgtaccggaagggggaacggggtcgtaggggtagggtttcggggtttaccaagttaaccttagttttaacgtccgttaaggttgggtacgtaacttaaacccgaatttaacttaaaccgtaacgacgtaaacggtaccttacgtgggttaagggaaacgggggttccttaaacgtttacccaaccctaacgttccgaacccggaaacgggaaaccaaaccggaccaaaacgtaaacctccaaccgttagtaaccgttttagaaaccttaaaataccggaaaaccnccccgtagaccggaacgacccggaaggacccgaacggtaccgtaattacgtaacctggacgaaccgaacgtaaacgtaccccgtgtaccgtttacgtttactttaccgg

SEQ ID NO: 317903 - DNA, 637 bp, Homo sapiens
  misc_feature: GZ8MTXP02JUARZ.10.79.H02.1.454.CMB.2.raw
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggaggtcttgggtcaaggccgtgggacgggtccctggacgactctcctgtgcagcctcnggnttcgcctgtggtattgacgttcagtgtactactacatcgaccgtcgggtccnccgaggcctcggaaggggacgggctggagttgggttaccatactatttacgcgtaggtggtnactactatactacctacgctagtactcgtgtaggaacggggcctattaccgaactactacccgtaccggaacgggaaccaaccgaccaaagtaccctcacttacgttacttcgaaacctaaagtcgaacccacccgtagacggacgaccggacggaccgtaccggtacgttaacttagttaccgtagtagaaccggtaataaaccgttacccgttcgtacccgttaaggtttacctttaaccg

SEQ ID NO: 317904 - DNA, 572 bp, Homo sapiens
  misc_feature: GZ8MTXP02GH3O7.10.79.H02.1.454.CMB.2.raw
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (523)..(523): a, c, t, g, unknown or other
  misc_feature (523)..(523): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctcgtggattgacgttcagtgactactacatgacctgggtccnccaggctccgaggggagggctggagtggttccatacatttanctagtggtgataccatatactacgcagactcgtgtaggaaacgggccaatttccaaccctatccgtaccgaaggggaccaaacggcccaaagactcactgtaactttgaactaaatcgaaacaccctgacgacgccgaaggaccacggccttatacgttacngtcgaacgtaacaacgttaccccggtcgaccgtttaggttactttaccg

SEQ ID NO: 317905 - DNA, 675 bp, Homo sapiens
  misc_feature: GZ8MTXP02F4BSV.10.79.H02.1.454.CMB.2.raw
  modified_base (326)..(326): a, c, t, g, unknown or other
  misc_feature (326)..(326): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagcctctggacttccgcctcgtggattgacgttcagtgactactacatcgacctgggtcccncgaggcctccgaggggagggctggagtggttcatacatttctctagtggtgatacctatactactacgcacgtactcgtggtaggaaacggggtcctagtttaccaccctacgttacccgtaccggaaacggggaccaaaaccggaccccaaaacggtaacccttaccgtaaccgttacgggtaacctttttaacggaacctaaaacgtaccggtaaaaccctaccccgtggaacccgacggaccggacgggaaccgaccgggtaccgttaacgttacgttacgtaggtacggaacgtaacgtaaaccttaccccggttctaccggtttacggtttaacctttacccgg

SEQ ID NO: 317906 - DNA, 561 bp, Homo sapiens
  misc_feature: GZ8MTXP02GW821.10.79.H02.1.454.CMB.2.raw
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (513)..(513): a, c, t, g, unknown or other
  misc_feature (513)..(513): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctcgtggattgacgttcagtgactacacatgacctgggtcccgccaggcctccgaggggaaggggctggggagttggggtttaccagtacatttatcctaggtggtgataccatactactcgnagactctgtgaaggcattcaccatctcgagggacaacgccaaagactcacgtgacttgactaaancgaaacncccgtncgagccgtaaggacaccggaccgtatacgttacgngtacgaacgaacgtaaccttacccgttcgtaccgttagtttacttacg

SEQ ID NO: 317907 - DNA, 539 bp, Homo sapiens
  misc_feature: GZ8MTXP02HU9XC.10.79.H02.1.454.CMB.2.raw
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (505)..(505): a, c, t, g, unknown or other
  misc_feature (505)..(505): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctgggagggtccctgagactctcctgtgcagcctctggattcgcctctggattgacgttcagtgactactacatgacctgggtccncaggctcgagggaggctggagtggttcatacntttatctagtgtgataccattatactacgcagactctgtgaagggccgtattcaccctatcctccagggacaacgcccaaagaactcactgactttagcaaatgaacacctgacgcgaccgaggaccacggccgtaatacgttactgtgaacganaactaacccggtctaccgttggtttactttaccg

SEQ ID NO: 317908 - DNA, 591 bp, Homo sapiens
  misc_feature: GZ8MTXP02IY65O.10.79.H02.1.454.CMB.2.raw
  modified_base (321)..(321): a, c, t, g, unknown or other
  misc_feature (321)..(321): n is a, c, g, or t
  modified_base (462)..(462): a, c, t, g, unknown or other
  misc_feature (462)..(462): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctgggtggaggtctgggggaggcttggtcaagcctgggagggtccctgagactctcctgtgcagccctcgtggattcgcctctggattgacgttcagtgactacacatgacctgggtccncaggctcgagggagggctgggagttggttccatactattactctaggtgtgataccatatactacgcagactctgtgaacgggctatcaccatctacgaggacacgccaaagactcactgacttgactaaatcgaaaaccncccgtaggaccgaacggcccgaagggaaccaaccgggggtacccttaagttaccttaaccgttggaacgtaacggaaacgtaaccgttaaacccccggttcgacccgtttagggtttaactttacccgg

SEQ ID NO: 317909 - DNA, 594 bp, Homo sapiens
  misc_feature: GZ8MTXP02GR6PI.10.79.H02.1.454.CMB.2.raw
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
  modified_base (499)..(499): a, c, t, g, unknown or other
  misc_feature (499)..(499): n is a, c, g, or t
  modified_base (544)..(544): a, c, t, g, unknown or other
  misc_feature (544)..(544): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattccgcctcgtggattgacgttcagtgactactacatgacctgggtccnccgaggcctaccggaggggagggcgtgggagttggttaccagtactatttacnctagtgtgactacatatactacacagactcgtgtaggaacgggcctaattcccacctatccgtaccgaacgggaccaaacgaccctaaaagaccttcacgtagtactttagaacaaatcgaaaccncccgtgacgacgaccggaggaccaccggtacttaactacttacgngtacgaacgtaaacgtaaccttacccgttcgtacgtttacggttacttcg

SEQ ID NO: 317910 - DNA, 711 bp, Homo sapiens
  misc_feature: GZ8MTXP02FWMOR.10.79.H02.1.454.CMB.2.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (396)..(396): a, c, t, g, unknown or other
  misc_feature (396)..(396): n is a, c, g, or t
  modified_base (645)..(645): a, c, t, g, unknown or other
  misc_feature (645)..(645): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagagactcaccatggagtttgggctgagcttgggttttccttgttgctattaataaaggtgtccagtgtcaggtgaagctggtggagtcgtgggggagcttggtcaagccgtgggacgggtccctgagctctcctgtcgcagcctctggacttccgcctcgtggtattgacgttcagtnactactacatcgaccgtgggcccnccaggcctccggaggggacgggctggggtagttcgggttaccattacgtatttacgtccgttagtggtnactaccatactacctacgctaagtacttcgtaggtacggaaacggggtccctaacttccaacccgtacgttacccgtacccggaaagggggaacccaaaacccggaacccaaaagtaaaccctccgtaacgttaccggttaactttacgaaacctaaaacttccgaaaaacccgccccgtaggacccggaaccggacccgggaaaacggacccgtaaccgggtaccgtttaagttaccgttttaaccgnggtaacgaaccgtaaaacgtaaacccgtttaccccgttcgtaccgtttacggtttaacctttaccg

SEQ ID NO: 317911 - DNA, 620 bp, Homo sapiens
  misc_feature: GZ8MTXP02JIMPL.10.79.H02.1.454.CMB.2.raw
  modified_base (318)..(318): a, c, t, g, unknown or other
  misc_feature (318)..(318): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggtcttgggtcaaggccgtgggacgggtccctgacgactctcctgtgcagtcctctggacttccgccttctggattcgacgttcagtgactactacntcgaccgtgggtcccgccgtaagggccctaccggaagggggaacggggctcggggtaggttggggtttacccagttactatttactcgttaggtgtgatacctatactactacgcagactcgtgtagaagggccgtaattccaccacttccacgaggaccaacgaccaaagacctcgaacttcgtactttacgacctaaatcgaaaccacccgtagcgacggcccggaggaccgaccggacctagttactaccgtgtacgaacgaacgtaaccttacccggtctcgttacgttactttaccg

SEQ ID NO: 317912 - DNA, 757 bp, Homo sapiens
  misc_feature: GZ8MTXP02IBQS5.10.79.H02.1.454.CMB.2.raw
  modified_base (338)..(338): a, c, t, g, unknown or other
  misc_feature (338)..(338): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgctattataaaaggtgtccagtgtcaggtgaagcgtggtggagtcgtagggggagtcttggtcaagccgtgggacgggtccctgacgactctcctgtgcagcctcgtggacttccggcctcgtggtattcggacgttcagtgactactacatcgaccgtgggtcccncgaggctaccggaggggacgggctgggagtggttaccagttactatttagtccgttaggtggtgtaacttaccattactacctacgactacgaccttcgtaggttacggaaacggggtcccgtaactttacccgaaacctacgttacccgtaacccggaacggggtaaaacccaaacccgggaaaccctaaaacggtaaacccttacaaaccgtttacggttaacccttttaggaaaccctaaaacgttaccgaaaacccgtacccgtacgggaaccgaaacggacccgggaaaacggaacccggaacccgggttacccgttaaagtttaaccgtttacgtacgggtacgaaccggtaaacgttaaaccgttaaacccccggttcgttacccgtttacgggttttaaaacctttcccgg

SEQ ID NO: 317913 - DNA, 639 bp, Homo sapiens
  misc_feature: GZ8MTXP02I58E1.10.79.H02.1.454.CMB.2.raw
  modified_base (326)..(326): a, c, t, g, unknown or other
  misc_feature (326)..(326): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagctctcctgtgcagcctcgtggattccgcctctggattgaccgttcagtgactactacattcggaccgtcggggtcccnccgagggtccctaccggagggggaacggggtcgtggggaggttcgggtttccattactattttacgtcctaggttggtgacttaccaattactacgtacgctagtacctcgtggtacgaacggggtccctattaccaccctatcctaccgacgggaccaaaccgaccaaagacttcaaccttgactttacgactaaagtcgaaacctcccgtagacgacgaccggaggaccgacggtaccgttaatacgttacgtggtacgaacgtaagtaaccgttaacccggttcgtcccgtttacggtttaactttaccg

SEQ ID NO: 317914 - DNA, 564 bp, Homo sapiens
  misc_feature: GZ8MTXP02J1ZE9.10.79.H02.1.454.CMB.2.raw
  modified_base (323)..(323): a, c, t, g, unknown or other
  misc_feature (323)..(323): n is a, c, g, or t
  modified_base (384)..(384): a, c, t, g, unknown or other
  misc_feature (384)..(384): n is a, c, g, or t
  modified_base (477)..(477): a, c, t, g, unknown or other
  misc_feature (477)..(477): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggacgggtccctgagactctcctgtgcagcctcgtggacttccgcctctggattgacgttcagtgactactacatcgacctgggtcccncgaggctccggaggggagggctagggaggttggtttccatactatttactcgtaggtggtnactaccatatacacgcagactcgtgtaggaacgggccattccacatcaccgaggacaacgcaaagactcactgtacttgacaaatcgaaaccnccgtgaccgacgccggaagaccgacgggaccttatactacgtgtacgcgaacgtaactacccggttgccgtttaggttacttacccg

SEQ ID NO: 317915 - DNA, 591 bp, Homo sapiens
  misc_feature: GZ8MTXP02H80QY.10.79.H02.1.454.CMB.2.raw
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggagtcttggtcaagccgtgggacgggtccctggacgactctcctgtgcagcctgtggattccgctcgtggtatgacgttcagtgactactantcgaccgtgggtcccncgaggcgtacgaggggagggctgggagtgggttacatactattactctaggtgtntaataccataactacgtacgcagacctcgtgtaggaacggccgtattacaccattcccgacgacggaacaaccgacaaacgactacatgtactttgaaccaaatacgaaacctacccgtgacggaacgccgaaggtaccgacgtaccgtatacgttacgtgcgaacgacgaaaccttacccggttcgtaccgttacgtttaacttaccg

SEQ ID NO: 317916 - DNA, 610 bp, Homo sapiens
  misc_feature: GZ8MTXP02JUNJ8.10.79.H02.1.454.CMB.2.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaanagccacgctctcctgcagggccagtcagagtctagcagcaactacgttgcctggtaccaacagaaacctggaccaggcctcccgggctcctcatctatgtacatcagcaggccagtggccatccagactaggtcagtggagtgggtctgggacagtacttcactctcaccatcgancagctggatcgngaagtatttgactagtgttattagttgtacaagtactaaagttagttagggtaacggtaccgtaccgttagggggttaacgttttcggggaacccggtaacgggggaaccctaaaacgggtcggtaacgggtaaggtaaacgttaaccgaaaaacggtacgttcgggtaacggtcgtaacggacctaaccgtagttactcggtttaccttacgtttaccc

SEQ ID NO: 317917 - DNA, 604 bp, Homo sapiens
  misc_feature: GZ8MTXP02GNIQP.10.79.H02.1.454.CMB.2.raw
  modified_base (453)..(453): a, c, t, g, unknown or other
  misc_feature (453)..(453): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagccgtgggagggtccctgagactctcctgtgcagcctctggattccgcctctggtattcgacgttcagtgactactacatcgacctcgggtccgccgaggcctccgaggggagggctgggaggttgggtttcattactatttatccgtagtgtgatacattatactacgcagctcgtgtagaagggcctattcaccatcctaccgagacaacgaccaaanacctcactagtaccttagactaaatacgaaacctcccgtggaccgacggaccgaacggaccgaccgggtacccttaagtttaacgttaccgtggtacgaacgtaaagtaaacccgttacccgtcgtacccgtttaggtttaactttacccg

SEQ ID NO: 317918 - DNA, 609 bp, Homo sapiens
  misc_feature: GZ8MTXP02GJIIA.10.79.H02.1.454.CMB.2.raw
  modified_base (504)..(504): a, c, t, g, unknown or other
  misc_feature (504)..(504): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggaggtccctgagactctcctgtgcagcctctggattccgcctcgtggattgacgttcagtgactacacatcgaccgtgggtcccgcgaggcctccggaggggagggctggggagttgggttaccatactatttactccgtaggttggtgaactaccattactacctacgcagtactgtgtaggaacggccgtattccaccattccgaccgaggaaccaacggacccaaagacctcacgtagtacttcgaactaaatacgaaacccncctagaccgacgacccggaaggacctaccgggtacctattacgttaccgtgtacgaacgtaaacgtaacctaacccggttcgtaccgtttaggtttactttaccg

SEQ ID NO: 317919 - DNA, 612 bp, Homo sapiens
  misc_feature: GZ8MTXP02H5URE.10.79.H02.1.454.CMB.2.raw
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctgggacgggtccctggacgtactctcctgtgcagcctcgtggacttccgcctcgtggattgacgttcagtgactactacatcgaccgtggtcccnccgaggcctacggaggggaacgggctagggagttggttaccatactatttacncgtagtggtnataccattanacctagcagactctggtagaacggccgtattaccgacctatccaccgacgggaaccaaacgaccaaagaacctcactaggtacctttgaaccctaaaagtcgaaacccacccgtcgaccggacgacccggaacggtaccacggtaccgtatactacgtgtacgaacgtaacgtaaacctacccgttacgaccgttacggtttaacttaccg

SEQ ID NO: 317920 - DNA, 519 bp, Homo sapiens
  misc_feature: GZ8MTXP02FHHLG.10.79.H02.1.454.CMB.2.raw
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgctctggattgacgttcagtgactactacatgacctgggtccgccaggctccgaggggaaggggctggagtgggttccatacatttatcctagtggtnataccatatactacgcagactctgtgaagggccattcaccatcncaggacaacgccaaagactnactgacttgacaaatgaacaccctgcgagccgagacacggccgtanacttacngtncgagactaccgtcgacctgtacttacg

SEQ ID NO: 317921 - DNA, 730 bp, Homo sapiens
  misc_feature: GZ8MTXP02JGITP.10.79.H02.1.454.CMB.2.raw
  modified_base (265)..(265): a, c, t, g, unknown or other
  misc_feature (265)..(265): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgtctattataaaggtagtccagtgtcaggtgaagctggtggagtcgtgggggagggcttggtcgaagccgtgggggtccgtgagactctctgtgcngcctctggatcgctctgattgacgttcagtgactactacatcgaccgtggtcccgcacggctacccggaggggaacggggtcgtgggtaggttggggtttactacgtacgtactttacttaccgttaggttaggtagacgttaacctaattacgttaacctacgacgtaacgtaccttcgtgggtaagggtaacccggggaccgtactttacccaaccctacgttaccttacccggaaaggggaacccaaaccggtaccccaaaacggttaaacctccgttaaccgtagttaacccgtttagaaaccctaaaagttcgaaaacccccgtcccgtgggaaccggacggaacccgggaacgggtaacccgaccggggtacccttaaattaacgttaccgtaggtggtaccgaacgtaaaaccgtttaccccggttccgtcgtttaacggtttactttacccgttagg

SEQ ID NO: 317922 - DNA, 557 bp, Homo sapiens
  misc_feature: GZ8MTXP02I5SJY.10.79.H02.1.454.CMB.2.raw
  modified_base (422)..(422): a, c, t, g, unknown or other
  misc_feature (422)..(422): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgaccgtgggtcccgcgaggcctccggaggggacggggctgggagtgggtttcagtactatttatcctagtgtgatacatatactacgcagactctgtgaacggggccattcacctntctcgagggacaacgccaagactcgactgtacttgacaactgaaccacctagccgagccgaggaccgacggaccgtatacttacgtgtagcgtaacgaacgttacccgttacgcccgtttaggtttacttaaccg

SEQ ID NO: 317923 - DNA, 645 bp, Homo sapiens
  misc_feature: GZ8MTXP02IBQZH.10.79.H02.1.454.CMB.2.raw
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagtcttggtcaagcctgggagggtccctgacgactctcctgtgcagcctcgtggacttccgcctcgtggacttgacgttcagtgactactacatcgaccgtgggccncgaggctccggaggggacgggctgggagttcggtttccattactntttactccgttaggtcggtnacttaccattactaaccgtacgctagacttcgaggtacggaacgggcctatttccgacctattcccgtaccgagggaacctaaaccgaccaaacgtaaccgtcctaaacgttgtaacctttagaacctaaagtaccgaaccctaacccgtcgaacggaacggaccggaacggaaccaccggtaccgttaattacgttacgtgacgtaacgaacgtaacgttaccccgttcgaccgtttacgtttactttacccg

SEQ ID NO: 317924 - DNA, 641 bp, Homo sapiens
  misc_feature: GZ8MTXP02IAMBR.10.79.H02.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcatagtagtgcacgaccggtgctcgatttagtgtcacacgaaggggaaagggggctgctcagttaggacccagagggaaccatggaaaccccagcgcagcttctcttcctcctgctactctggctcccagataccaccggagaaattgtgttgacgcagtctccaggcaccctgtctttgtctcgaggggaangccagctctcctgcagggccagtcagagtcttagcagcaactcgtgcctgaaccaacagaaacctggccaggcctcccgggctccctnatctatggtacatctagcgaggccagtggcactcccgagactaggtcaggtggcaggtgggtacgtgggactagtacttccgactcctcacctatccgacgcagaccgtggacgttacgtaggtaaagttcgttttagacgttaggttagttaatttagttagtacgtagtacgtaaagttaggttacgggttaggtaccgtaccggttaggggttacgttttacggggaccggttaaggggacccgtaagggtaccgttaggggaacgttacgtaaacgttaaaaccgggacgttacggttacggcgtacggaacctaccgtagttccgtacgtttccctacttacctttccccg

SEQ ID NO: 317925 - DNA, 880 bp, Homo sapiens
  misc_feature: GZ8MTXP02F786E.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggagcgttggtcaagccgtgggaggtccctgagactctcctgtgcacgcctctggattccgcctcgtggattgaccgttcagtgacttaactacagtcgaccgtcggggtcccgccgagggccctcccggaaggggggaaacgggggtcctggggtaaggttcgggggtttacccaagttaccgttaatttttacgttacccgttaagggttcgggttagtaaacttaaacccgtaatttaaaccgttaacccgtaaccgggtactaacggtaaccctttcggtaacggtacgggaaacgggggtccctaaagtttacccaaaccccgttaattacccggtaccccggaaaacggggaaacccgaaaaccccggaacccgtaaaaacggtaaaccctcctaaaaccgtttacgggttaaaccttttacggaaaccgttaaaactacgggtaaaaacccccaaccccgttcgggaacccggtaacggaacccccggggtaaacgggaaccccggtaaaacccgggggttaaacccggttaaaagtttaaccgtttaaacggtccgggttacggggaaaccggttaaaacggttaaaaccgttaaaaccccccggggtttcggtaaccccgttttaaggggttttacccttttaaaacccggg

SEQ ID NO: 317926 - DNA, 570 bp, Homo sapiens
  misc_feature: GZ8MTXP02FPYRX.10.79.H02.1.454.CMB.2.raw
  modified_base (525)..(525): a, c, t, g, unknown or other
  misc_feature (525)..(525): n is a, c, g, or t
  modified_base (537)..(537): a, c, t, g, unknown or other
  misc_feature (537)..(537): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggtcttgggtcaagcctgggagggtccctgagactctcctgtgcagcctctggattcgcctcgtggattgacgtttcagtgactactacatgaccgtgggtccgccaggctccggaggggaaggggctgggaggttgggtttccagtactatttatcctagtgtgatacatatactacgcagtactctgtagaaggggccgattccacctatcctccgaacgggaccaaacggccaaagacctcaactgtactttgacaaatcgaaaccaccctgacgacgccgaaggcacggctatactacngtacgaacgaanaactacccgtcgaccgttaggttactttaaccg

SEQ ID NO: 317927 - DNA, 613 bp, Homo sapiens
  misc_feature: GZ8MTXP02JDY3U.10.79.H02.1.454.CMB.2.raw
  modified_base (281)..(281): a, c, t, g, unknown or other
  misc_feature (281)..(281): n is a, c, g, or t
  modified_base (412)..(412): a, c, t, g, unknown or other
  misc_feature (412)..(412): n is a, c, g, or t
  modified_base (531)..(531): a, c, t, g, unknown or other
  misc_feature (531)..(531): n is a, c, g, or t
  modified_base (569)..(569): a, c, t, g, unknown or other
  misc_feature (569)..(569): n is a, c, g, or t
tcagcatagtagtgcacgaccggtgctcgatttagtgtcacacgaaggggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggacgggtccctgagctctcctgtgcagcctgtggatcgcctntggattgacgttcagtgactactacatcgaccgtgggtcccgcgacggcctccggaggggaacggggcgtaggggtaggtttcggggtttacccaagtttaccgtatttttacgtcccgttaggttgggtntaacttaacccgtaattacgtaaccttacggacctagtaccttcgtggtaggaacgggcctattccacctatccgtacgaggacaacgaccaagactcactgtactgactaatcgaacncctagcgaacgcgacggaccaacggtctaattctacgngtacgaacgaactaacgttacccggctacgttcgtttactaccg

SEQ ID NO: 317928 - DNA, 800 bp, Homo sapiens
  misc_feature: GZ8MTXP02JN5J7.10.79.H02.1.454.CMB.2.raw
  modified_base (769)..(769): a, c, t, g, unknown or other
  misc_feature (769)..(769): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggacgggtccctgacgactctcctgtgcagcctcgtggattccgcctcgtggtattcggacgtttcagtcgaacttactactagtcggaccgttcggggtccccgccgaacgggcccgtaccggaaggggggtaacggggcgttaggggtaggtttcggggtttacccaagttaccgtaatttttacgtaccgttaggttgggtagaacttaccaattactaacgtacgctaacgtaccttcgtaggtacgggaaacggggtccctaattcccaacccgtaacgttccccgtaaccggaaacggggtaaccccaaaacccggtaccccgtaaaacggtaaccccttacaaaccgtttacggttaaaaccgttttaccgaaaaccgttaaaacttcccggaaaaccctcccccggtagggaccccggaaaacggaccccgggttaaaagggacccgtaaccccggggtacctttaaagtttaaccgttacgttcggaacgtaacggaaacgttaaaaccttacccccggggtntacccggtttagggtttaactttaacccggg

SEQ ID NO: 317929 - DNA, 551 bp, Homo sapiens
  misc_feature: GZ8MTXP02FNM39.10.79.H02.1.454.CMB.2.raw
  modified_base (322)..(322): a, c, t, g, unknown or other
  misc_feature (322)..(322): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
  modified_base (463)..(463): a, c, t, g, unknown or other
  misc_feature (463)..(463): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctgggagggtccctgagactctcctgtgcagcctctggattcgcctctggattgacgttcagtgactactacatcgacctgggtccnccaggcctccgaggggagggctgggagtggttccatacatttancctagtggtnataccatatactacgcagactctgtgaagggcattcacatcnccgaggacaacgccaaagactcactgacttgacaaatcgaaaccnccctagcgacgccgaggaccacggtcctaatacttactgtacgaacgtaagaaactaaccccgttcgaccttaggtttaactttaccg

SEQ ID NO: 317930 - DNA, 620 bp, Homo sapiens
  misc_feature: GZ8MTXP02I2J0W.10.79.H02.1.454.CMB.2.raw
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (513)..(513): a, c, t, g, unknown or other
  misc_feature (513)..(513): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctatataaaggtgtccagtgtcaggtgaagctggtggagtcgtgggggagcttggtcaagcctgggacggtccctgagctctctgtgcagcctctggacttcgctctggattgacgttcagtgactactacatcgacctggggtcccnccgaggctccggaggggagggctgggagttggttacagtactatttactctagttcggngactacatatactacgcagtactgtgtacgaaacgggccctatttacccacccaatccctacccggaagggaaccaaaccggacccaaaaggtaacccttcaactggtaaccctttagacctaaaatcgaaaacccnccgtagaccgacgaccggacggtaccgacggtacgttaattacgtacgtggacgaacgtaaacgtaaacccgttaccccggtcgtaccgtttacggtttaacttccg

SEQ ID NO: 317931 - DNA, 586 bp, Homo sapiens
  misc_feature: GZ8MTXP02IB759.10.79.H02.1.454.CMB.2.raw
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (499)..(499): a, c, t, g, unknown or other
  misc_feature (499)..(499): n is a, c, g, or t
  modified_base (542)..(542): a, c, t, g, unknown or other
  misc_feature (542)..(542): n is a, c, g, or t
  modified_base (564)..(564): a, c, t, g, unknown or other
  misc_feature (564)..(564): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtggggggagcttgggtcaaggcctgggacgggtccccgagactctcctgtgcagcctctggattcgcctctggattgacgttcagtgactactacatgacctgggtcccgccaggcctccggaggggaggggctaggggagttgggttcagtactatttacnccttaggtggtanactacctatatacctacgcagtactctgtagacgggctacttcacctatctaccgaacgggaccaacgaccaaagaacctctacgtgtaactttgacaaatagaaaccncctagacgacgccggaacggacacggtacctatacttactgtnacgaagtaaactacccggttcnccgttaggttacttaccgtacg

SEQ ID NO: 317932 - DNA, 649 bp, Homo sapiens
  misc_feature: GZ8MTXP02H8JQG.10.79.H02.1.454.CMB.2.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaaangccacgctctcctgcagggccagtcagagtcttagcagcaacttacgttgcctaggtaccaacgaacgaaacctcggccaggcctcccgggctccctcatctagtggtacatctagcgaggccacgtcggacactacccgagacgtagggttacaggtcgggacgtagggtcggggtcgtaggggactagtacctttccaactcctaccaccatacgagacagacgtaggagttacgtagtaaagtttgttttagagttagtttagttaattttagtttcgtaacgtaggtacttaaagttaggttagggttaacggttaccgtacccggttggggttaacgttttcggggaccggtaacgggggtaaccaagggacgttagggacgtaaacgttaacgaaaacgtacgtggtacgcgtacgaccactatccgttacgttccttacg

SEQ ID NO: 317933 - DNA, 837 bp, Homo sapiens
  misc_feature: GZ8MTXP02GVEIC.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggagggtccctgagactctcctgtgcagcctctggattcgcctctggtattgacgttcagtgactactacatcgaccgtggggtcccgccgaggcctaccggagggggtaacggggcgtgggaggtttggggtttaccagttactattttactccgttaaggttgggtgtaacttaacccgaattaacttaaccgtaacggacctaacgtaacccttcgttagggttaacgggaaacgggggtcccgtaatttaccccgaaccctaaacgttccccgtacccggaaaacgggggaaacccctaaaaacccggggtaccccaaaaaacgggtaaacccctttacccgaaaccgtttacggttaaacctttttaacggaacccttaaaaaacggttccggaaaacccctaacccccggttacgggacccggtaaaccggggaacccccgggaaacgggggaaaccctaaacccgggggttaccccggttaaaatttaacgttttaacccgtgggttaaccggaaccggtaaaacggtaaaacccgtttaaacccccgggtttcggtaccccttttaagggggtttaaacccttttaacccgg

SEQ ID NO: 317934 - DNA, 606 bp, Homo sapiens
  misc_feature: GZ8MTXP02IUY9V.10.79.H02.1.454.CMB.2.raw
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcacacgaagggaaaggggagctctgggagaagagccccagccccagaattcccaggagtttccattcggtgatcagcacttaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctctggattcgcctctggattgacgttcagtgactactacatgacctgggtcccnccaggctccgaggggagggctggagtggttcatacatttatctagtggtnataccatactactacgcagactctgtaggaacgggccgtattccacctatcctaccgaaggggaccaaacgaccaaacgaacctcctaactcggtaactttacgaacctaaaatacggaaaccctaccccgtggaccgaacggccccggaaagggacccaccggggtacccgtaattacttacgtgtgacgaagtaaacgtaacccgttcgaccgttaggtttactttacccgttagg

SEQ ID NO: 317935 - DNA, 631 bp, Homo sapiens
  misc_feature: GZ8MTXP02FY5MT.10.79.H02.1.454.CMB.2.raw
  modified_base (320)..(320): a, c, t, g, unknown or other
  misc_feature (320)..(320): n is a, c, g, or t
  modified_base (516)..(516): a, c, t, g, unknown or other
  misc_feature (516)..(516): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagcttggtcaagcctggacgggtccctgagactctcctgtgcagcctctggattccgcctcgtggattgacgttcagtgactactacatcgacctgggtccnccgaggcctaccggaggggaacggggctggggaggttggggttaccagtactatttatcctaggttggtgactacatatacctagcatactcgtgtacgaacggggtcctattccgacctatccgtaccgaagggacccaaacggaccaaacgtaaacctcacttagtacctttacgacctaaaagtcgaaacccnccgtacgacggacgaccggacggaccacgggtacccttaagtacgtttacgtggtacgaacgtaaacgtaaccgttaaccccggttcgtacccgtttaggtttaactttacccgg

SEQ ID NO: 317936 - DNA, 531 bp, Homo sapiens
  misc_feature: GZ8MTXP02ITBBJ.10.79.H02.1.454.CMB.2.raw
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattccgcctctggattgacgttcagtgactactacatgacctggtccgcaggctcgagggagggctggagtggttccatacatttanctagtgtgatacatatactacgcanactntgtgaagggcatcacatctcgaggacaacgccaagactcactgacttgactaaagtcaaaccacccgtgcgacggaccgaggaccacgggactatactactgtcgaacgacaaacttacccgtcgaccttagtttactttacg

SEQ ID NO: 317937 - DNA, 662 bp, Homo sapiens
  misc_feature: GZ8MTXP02IRMWV.10.79.H02.1.454.CMB.2.raw
  modified_base (333)..(333): a, c, t, g, unknown or other
  misc_feature (333)..(333): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggaggcttggtcaagccgtgggacgggtccctgagactctcctgtgcagcctcgtggatccgcctcgtggtattcggacgttcagtcgactaactacatcggacccgtggggtcccncgaggccgtccggaaggggaggggctagggaggttgggtttaccattaccgtatttacgtccgttaggtggtgtaactaacctaagttactaacctacgactaacggaccttgtaggtacggaacggggaccctattacccaactagtccctaccgggaacggaccaaaacccggccaaaacgaaccctttccgaaacttcgggtaactttcgaaactaaaatacggaaaccctacccgtggaccgaagacccggaagaccgacggtacgttatacttacgagtacgaacgaagtaaaccgtacccgttcaccgtttagttacttaccg

SEQ ID NO: 317938 - DNA, 638 bp, Homo sapiens
  misc_feature: GZ8MTXP02GOPNT.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatgacctggtccgccaggcctccgaggggagggctgggagttgggttccatactatttactcctagtggtgataccatatactacgcagactctaggtagaacggggtcctaattccaccctatacccgtaccgaggggaccaaaccggcccaaaacggaaccttcaacgttacggtaaccttttacggaacctaaaagtcgaaaaccctcccgtaggaccgaacgtccccggaaaggggaccaacccggggaccttaatacgttaccgtggtacgaacggaaacgtaaacgttacccccggttcacccgtttaggtttaacctttacccgg

SEQ ID NO: 317939 - DNA, 606 bp, Homo sapiens
  misc_feature: GZ8MTXP02G1LKN.10.79.H02.1.454.CMB.2.raw
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgcttattataaaaggtgtccagtgtcaggtgaagctggtggagtcgtgggggagcttggtcaagcctgggagggtccctgagactctcctgtgcagcctctggattcgcctctggattgacgttcagtgactactacatcgaccgtggtcccncaggctccgaggggacgggctgggagttggttccagtactatttacnccttaggtgtgactaccattactactacgctagtacctgtgtaggaacgggcctaagttcacccatcctaccgagggaccaaacgccgaaaagacctcaactggtactttgaccaaagtacgaaccaccctgaccgacgaccggacggaaccgaccgggtacctaattacgtacgtgtacgaacgtaaacgaaaccgtttaacccggtcgtacccgtttaggtttactttaaccccg

SEQ ID NO: 317940 - DNA, 669 bp, Homo sapiens
  misc_feature: GZ8MTXP02G2M8M.10.79.H02.1.454.CMB.2.raw
  modified_base (325)..(325): a, c, t, g, unknown or other
  misc_feature (325)..(325): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggaggtccctgagactctcctgtgcagcctcgtggattccgcctcgtggtattggacgttcagtgactactacatcgaccgtgggtcccnccgaggcctaccggaggggacggggctggggagttggttccatactatttatctaggtggtnactaccattactactacgcagtactcgtaggtaggaaacggggccctattaccaccctatcccgtaccgaaggggaacccaaaccggacccaaaagtacccttaccaacgtttacggtaaaccctttgaacctaaaagttaccgaaacccgtaccccgtaggaccggaacggaccccggaagggaaacccaccggggtaccttaattaacgtttaccgtggtacggaaccggtaaacgtaaaccgttaaccccggttcacgtttacggtttacggtttaacc

SEQ ID NO: 317941 - DNA, 700 bp, Homo sapiens
  misc_feature: GZ8MTXP02GBL5V.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctggagggtccctgagctctcctgtgcagcctgtggattcgctcgtggtattgacgttcagtgactactacatgaccgtgggtcccgccgaggccctaccggaagggggtaagggtcgtagggacggttggggtttaccagttacgtattttacgtccgtaggttcggtgaacttacgattactaactacgcagtactcgtaggtaggaacgggcctaagttaccacctatcccgtaccgaacgggacctaaaccggacctaaaagacccttaccaacgttacgtaaccgtttacgaacgtaaaacgtacgaaaaccctccccggtaggaccggaacggacccggtaaacggggaaacccggtacccgggtaaccgtttaacgttaacgtttaaccgtggttacggaacgtaaacgtaaacccggtttaaccccgttcggtacctttacgggtttaactttacccgg

SEQ ID NO: 317942 - DNA, 602 bp, Homo sapiens
  misc_feature: GZ8MTXP02JPQ1A.10.79.H02.1.454.CMB.2.raw
  modified_base (271)..(271): a, c, t, g, unknown or other
  misc_feature (271)..(271): n is a, c, g, or t
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (494)..(494): a, c, t, g, unknown or other
  misc_feature (494)..(494): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagtcttggtcaagccgtgggacgggtccctgacgactctcctgtgcagcctntggattcgctgtggattgacgttcagtgactactacatcgaccgtgggcccnccgaggcctaccggaggggacgggctgggaggttggttccatactatttacncgtagtgtgactacatactacacgnagactctggtagaacgggtccaattccaccctatccgtaccgagggaccaaacggtccaaagacctcacgtgtacttgaactaaatcgaaaccnccctaggcgaacgtaccggaacggaccacgggtaccgttaattacgttaccgtggtacgaacgaaagtaaccttacccggttcgaccgtttacggttaactttaccgg

SEQ ID NO: 317943 - DNA, 700 bp, Homo sapiens
  misc_feature: GZ8MTXP02IVUE5.10.79.H02.1.454.CMB.2.raw
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcgttggtcaagccgtgggacgggtccctgagactctcctgtgcagcctcgtggattcgcctctggattgacgttcagtgactactacatcgaccgtgggtcccncgaggcctaccgaggggagggctgggaggttgggttccattactatttactccgtaggtggtgacttaccattactacctacggactaggaccttcgtaggtacggaaacgggggtccctaatttacccgaaccctagttccccgtacccggaaagggggaaaccccaaaacccgggaccccaaaaaggtaaaccccttccgtaaaccgtttcgggtaaaccctttttaggaacctaaaaagttcccggaaaaccctcccccgttaggacccgaacggacccggaagggaacccaccgggtacccgttaattacgttaccgtggtacgaacgaaacgtaaccgttaccccgtcgacctttaggttactttacccg

SEQ ID NO: 317944 - DNA, 603 bp, Homo sapiens
  misc_feature: GZ8MTXP02JTAZP.10.79.H02.1.454.CMB.2.raw
  modified_base (274)..(274): a, c, t, g, unknown or other
  misc_feature (274)..(274): n is a, c, g, or t
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
  modified_base (503)..(503): a, c, t, g, unknown or other
  misc_feature (503)..(503): n is a, c, g, or t
  modified_base (581)..(581): a, c, t, g, unknown or other
  misc_feature (581)..(581): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagcctcgtgnttcgcctctggtattgacgttcagtcgactactacatcgaccgtgggtcccgccgaggcctccgaggggacgggctggggagtgggtttccatactatttactcctaggtgtgactacctatactacgacncagtctcgtgtacggaaggcctatcacctntccgtaccgagggaaccaaccgaccaaagacctacacttacgtactttagaacctaaatcgaaacccnccgtagaccgagacccggaggacccaccgggtactacttacgttacgtgtacgaacgtaacgtaaccttaccccggtntccgttaggtttaacttacccg

SEQ ID NO: 317945 - DNA, 605 bp, Homo sapiens
  misc_feature: GZ8MTXP02GBO74.10.79.H02.1.454.CMB.2.raw
  modified_base (329)..(329): a, c, t, g, unknown or other
  misc_feature (329)..(329): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
  modified_base (519)..(519): a, c, t, g, unknown or other
  misc_feature (519)..(519): n is a, c, g, or t
  modified_base (555)..(555): a, c, t, g, unknown or other
  misc_feature (555)..(555): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgtgctattataaaaggtgtccagtgtcaggtgaagctggtggagtcgtgggggagcttggtcaagccgtgggacgggtccctgagactctcctgtgcagcctcgtggattccgcctcgtggtattgacgttcagtgaactactacatcgaccgtggggtcccnccgaggccctaccggaagggggaacggggtctgggaaggttggggtttacccagttacctatttacgccgttaagtgggtnaactaccattatactacgcaagacctgtgtagaaacgggtcccaagttccactatcctacgacggacaacgaccaaagacctnactgtacttcgacaaatcgaaacccncagacgacgacgacgacgacggtactatacttacgnggacgaacgtaacgtaaaccgttacccgtgtaccgtttacgttacttacg

SEQ ID NO: 317946 - DNA, 622 bp, Homo sapiens
  misc_feature: GZ8MTXP02GTWLS.10.79.H02.1.454.CMB.2.raw
  modified_base (504)..(504): a, c, t, g, unknown or other
  misc_feature (504)..(504): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctcgtggacttcgcctcgtggattgacgttcagtgactactacatgacccgttgggtcccgccgaggcctccggaggggaaggggctggggaggttgggttacatactatttatccgtagtggtgactaccattactaccgtacgcagtactgtggtaggaacggggcctattccactctccgacgacggaccaaccgaccaaagactcacgtacgtactttgaactaaatcgaaacccnccgtagaccgacggaccggacggtaccgaccgggtaccttaattacgttaccgtggtacgaaccggtaacgtaaacccgttaacccggttccgtaccgtttaggtttactttacccgg

SEQ ID NO: 317947 - DNA, 810 bp, Homo sapiens
  misc_feature: GZ8MTXP02H9E5N.10.79.H02.1.454.CMB.2.raw
tcagcatagtagtgcacgaccggtgctcgatttagtgtcacacgaagggaaaggggagctctgggagaagagccccagccccagaattcctaggagtttccattcggtgatcagcactgaacacagaggactcaccatggagtttgggctgagctgggttttcctgttgctattataaaggtgtccagtgtcaggtgaagctggtggagtcgtgggggaggtcttgggtacaagcgtgggacgggtccctggacgacctctcctgtgcagcctcgtggtctccgtcctcgtggtattggacgtttcgagtcgtaactactacagtcgaccgttcgggtccgccgaggtccgtccggagggggaacggggtcgttaggggtaggttcggggtttaccaagttacgttatttacgttccgttaggttgtagtaacttaacctaattaactaaccgtacgaccgtatacccgtgtaggttacgggaaacggggtccccgtaatttaacccgacccgttaacgttcccgtacccgggaacgggaaacccgtaaaaccccggaacccgtaaaaccggtaaacccttaccgtaaaccgttacgggttaaccttttaacgggaaaccctaaaacgtttaccggaaaccccttacccccgagggacccggtaacccggaccggaaaccggggaacccgtaacccgggaccggtttaaatttacggttacccgttaggtaccggaaccgtaaacgggttaaacctttaaaccccgggtttcggttaccccgtttaaaggttttacccgtttaaacccgg

SEQ ID NO: 317948 - DNA, 576 bp, Homo sapiens
  misc_feature: GZ8MTXP02JGKKV.10.79.H02.1.454.CMB.2.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttgggtcaagccgtggacgggtccctgagactctcctgtgcagcctntggattcgcctntggattgacgttcagtgactactacatgaccgtgggtccncgaggctccgaggggagggctggagtggttcatactatttanctagtgtgatacatatactacgcagactctggtagaacgggtccctagttccacctatccctaccgagggaccaaacgacaaagacctcactgtacttacgactaaatcgaaccacccgtgacgacgaccgacggaccacggtccgtaatacttacgtgacgaacgacggtaaaccttacccggtcgtaccgtttacggttactttaacccg

SEQ ID NO: 317949 - DNA, 652 bp, Homo sapiens
  misc_feature: GZ8MTXP02GX5CG.10.79.H02.1.454.CMB.2.raw
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
  modified_base (382)..(382): a, c, t, g, unknown or other
  misc_feature (382)..(382): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtggagggtccctgagactctcctgtgcagcctcgtggattcgcctntggattgacgttcagtgactactacatcgaccgtgggccnccgaggcctccgaaggggagggctgggagttgggttccagtactatttactctaggtggtnactaaccattactacctaagcaagactcgtaggtagaacggggcctaattccaacctatcctaccgaagggaacccaaaccgaccaaaagtaaccctacaacttacgtaactttacgaacctaaaatcgaaaaccctcccgtgaacccgacggacccggaaggaaacccgacccggggtaccacctaaattaacccgttacgttaggaacgaccggtaaaacgtaaaacccgttaaccccggttcgtaccccgtttagggttttaaaccc

SEQ ID NO: 317950 - DNA, 787 bp, Homo sapiens
  misc_feature: GZ8MTXP02GJI4K.10.79.H02.1.454.CMB.2.raw
tcagcatagtagtgcacgaccggtgctcgatttagtgtcacacgaagggaaaggggagctctgggagaggagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctctggattccgcctcgtggattgacgttcagtgactactacatcgaccgtgggtcccgccgaggcctaccggagggggaacggggctggggaggttcggggtttacccaagttactattttactcccgttaggttgggttagaacttacccaattaactaaccgtacgactaacggtaaccttcgttaggtacggaaacgggggtccctaagtttaccccaaaccctagttccccgtaacccggaaacgggggaaacccaaaaccccgggaccctaaaacggtaaaccccttaccctaaaccggtttaccgggtaaaccctttttacggaaaccttaaaaacgttcggaaaaaccccctcccccggttaggaccggaaccggaaccccggggaagggaaacccgaacccgggggtaccctttaaattaaccgtttaaccgtggttacggaacccggtaaagttaaaacccgtttaacccccgggttcggtaaccccgttttacggtttaaccttttaacccgg

SEQ ID NO: 317951 - DNA, 666 bp, Homo sapiens
  misc_feature: GZ8MTXP02I154T.10.79.H02.1.454.CMB.2.raw
  modified_base (270)..(270): a, c, t, g, unknown or other
  misc_feature (270)..(270): n is a, c, g, or t
  modified_base (326)..(326): a, c, t, g, unknown or other
  misc_feature (326)..(326): n is a, c, g, or t
  modified_base (596)..(596): a, c, t, g, unknown or other
  misc_feature (596)..(596): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaagccgtgggagggtccctgagactctcctgtgcagcctntggacttcgcctctggtattgacgttcagtgactactacatcgaccgtgggtcccncgaggcctaccggaggggacgggctgggaggttggttaccattactatttatcgtagtgtgactacatactactacgcagtactcgtggtaggaacgggtcccgtaactttaccgaaccctatcccgtaaccgacggggaaccaaaccggaccaaaaggaaccctcaacgtagtaacctttacgaactaaaactccgtaaacctacccggtagacccggaacgacccggaagggaaccctaccgggtaccgttaaattacgtttaaccgnggttaccgaacggtaaacgtaaaccgtttaaccccggttcgtaccctttagggtttaacctttaacccgg

SEQ ID NO: 317952 - DNA, 607 bp, Homo sapiens
  misc_feature: GZ8MTXP02GYWTT.10.79.H02.1.454.CMB.2.raw
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgtgctatataaaggtgtccagtgtcaggtgaagctggtggagtcgtgggggagcttggtcaagcctggagggtccctgagactctcctgtgcagcctctggattcgcctntggattgacgttcagtgactactacatcgacctgggtccnccaggctccgaggggaggggctgggagttggggtttccatactatttactcctagtgggtnactacatactactacgcagtctgtagtaggaacgggtcctattccaacctactcctaccgacgggaacctaaaccgaccaaaacgtaactaccaacgtacgtaactttagaactaaactaacgaaccgaccgtacgacgacggaccggacggacggaccggtacgtactacttacgtagtacgtaacgtaacgtaaacgtaaccgttaccgtaccgttacgtttacgtttacg

SEQ ID NO: 317953 - DNA, 671 bp, Homo sapiens
  misc_feature: GZ8MTXP02HD5U4.10.79.H02.1.454.CMB.2.raw
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcacacgaagggaaagggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtgggtggagtcgtgggggaggtcttggtcaaggcccgtgggacgggtccctggacgacctctcctgtgcagcctcgtggattccgcctcgtggtattggacgtttcagtgaccttactacatcgaccgtgggcccncgaggccctaccgaggggacgggctgggagttggttccatactattanctagtgtgatacatatactagcacgactcgtggtagaaacggggcctagttacccaccgacttcccgtaccgagggaacccaaaccggaccctaaaaggaacccttacgaaccttaggtaaccctttaggaacctaaaacgtcgaaaccctacccgtaggaccgaaccggaccggaacgggaaccgacccgggtaaccgttaattaacgttaaccgtggttacgaaccggtaaacgtaaaccgttaccccgttaccgtacccgtttaggtttaacctttacccg

SEQ ID NO: 317954 - DNA, 584 bp, Homo sapiens
  misc_feature: GZ8MTXP02JAZX5.10.79.H02.1.454.CMB.2.raw
  modified_base (502)..(502): a, c, t, g, unknown or other
  misc_feature (502)..(502): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttggtcaagcctggagggtccctgagactctcctgtgcagcctctggatcgcctctggattgacgttcagtgactactacatcgaccgtgggtcccgccgaggcctccggaggggaggggctgggaggttggtttccattaccgtatttactccgtagtggtgtataccattatacctacgctagactcgtagtggaacgggccgatttaccaccctatccctaccgagggaccaaacggacccaaagaacctcactgtacctttgacaaatcgaaccncctgacgaacgccggagaccgaccggcgtacttactcagtcgaacgtacgaacttacccgtcgaccgttaggttactttacg

SEQ ID NO: 317955 - DNA, 661 bp, Homo sapiens
  misc_feature: GZ8MTXP02GZARV.10.79.H02.1.454.CMB.2.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (438)..(438): a, c, t, g, unknown or other
  misc_feature (438)..(438): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtgggagggtccctgagctctcctgtgcagcctcgtggattccgccttcgtggattgacgttcagtgactactacatcgaccttgggccncgaggcctcgaggggagggctgggagttggttccatactatttntctaggtgtnactaacattaactactacgcaagtactcgtggtagaaacggggcctaattccaacccgnttacccacccggaagggaacccaaacgaccctaaaagaaccttcgaacttcggtaactttgaactaaaacgttcggaaaaccctccccgtagggaccgaacggaccggaaacgggaaccaaccgggggtaccttaaattaaccgtttacggtcggtaacgtaaccggtaaaacgtaacccgtttaaccccggttcgtaccgtttaacggtttaacctttaccg

SEQ ID NO: 317956 - DNA, 575 bp, Homo sapiens
  misc_feature: GZ8MTXP02GN3YI.10.79.H02.1.454.CMB.2.raw
  modified_base (184)..(184): a, c, t, g, unknown or other
  misc_feature (184)..(184): n is a, c, g, or t
  modified_base (270)..(270): a, c, t, g, unknown or other
  misc_feature (270)..(270): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (482)..(482): a, c, t, g, unknown or other
  misc_feature (482)..(482): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgtgctattataaaaggtntccagtgtcaggtgaagctggtggagtcgtgggggaggcttgggtcaaggcctgggagggtccctgagactctcctgtgcagcctntggattcgcctcgtggattgacgttcagtgactactacatcgaccgttggtcccgccaggcctccggaggggaaggggctgggagttgggttccatacatttatctagtgnactacatatactacgnagactntgtagaacgggccatcacctntcctacgaggaacaacgcaaagactacactagtaccttgacaaatcgaaacctaccgngacgacgccgaaggaccgacggtaccgtattacgtacgtgtacgcggtaagaaacttaaccccgttcggacgtttacggtttaactttacccg

SEQ ID NO: 317957 - DNA, 635 bp, Homo sapiens
  misc_feature: GZ8MTXP02IQUHA.10.79.H02.1.454.CMB.2.raw
  modified_base (405)..(405): a, c, t, g, unknown or other
  misc_feature (405)..(405): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtgggagggtccctgagactctcctgtgcagcctcgtggacttccgcctcgtggattgacgttcagtgactactacatcgaccgtgggtcccgccgagggcctaccggaggggaacggggctaggggaggttcgggtttaccagttacctattttactccgttaggttggtnactaaccattactacctacgcagtacctctaggtaggaacgggtcctattccaccatcccgtaccgaagggaccaaacggaccaaagaacctcaactgtaactttgacaaatcgaaaccncccgtgaccgacgaccggaggaccgacggtaccttaatacgttacgtggtacgaacgtaaggtaaaaccttaaccccggttcgtaccgtttacggtttaacctttaccgg

SEQ ID NO: 317958 - DNA, 634 bp, Homo sapiens
  misc_feature: GZ8MTXP02FW4QO.10.79.H02.1.454.CMB.2.raw
  modified_base (514)..(514): a, c, t, g, unknown or other
  misc_feature (514)..(514): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagccgtggacgggtccctgagactctcctgtgcagcctctggattcgcctctggattgacgttcagtgacctatacatcgaccgtgggtcccgcaggcctccggaggggaacggggctgggaggttggggtttacccagtactatttactccgtaggttggtgataccattactactagcagtactcgtggtagaacgggtcctattccaccctatcccgtcgaacgggaccaaacgccaaagtacctcaaccgttgtaactttagactaaaagtaccgaaaccncccgtagacccgaacgacccggaacggacccaaccgggtaccgttaattactttaccgtggttagaaccgtaacgtaaccttaacccccggttgccccgtttaggtttaacctttacccg

SEQ ID NO: 317959 - DNA, 634 bp, Homo sapiens
  misc_feature: GZ8MTXP02I8124.10.79.H02.1.454.CMB.2.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtggacgggtccctgagactctcctgtgcagcctctggattcgcctctggattgacgttnagtgactactanatcgacctggccncaggcctcgagggagggctggagttggttccatactatttactcgtagtgtgataccatactactacgcagactcgtagtggaacgggtcctattccaccgtatcccgtaccgaagggaccaaaccgaccaaagtacctacacgttcgtaacctttaggaacttaaaacgtcgaaacctacccccgtaggaccggaacggacccggaagggaaccgtacccggggaaacctttacgttaacgttaaccgtgtacgaaccggtaactaaaccggtttacccccgtacgtaccccgtttaggtttaactttaacccg

SEQ ID NO: 317960 - DNA, 593 bp, Homo sapiens
  misc_feature: GZ8MTXP02FQYRQ.10.79.H02.1.454.CMB.2.raw
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagccgtggagggtccctgagactctcctgtgcagcctctggattcgctctggattgacgttcagtgactactacatgacctgggtccncaggcctccgaggggagggctgggagtgggtttccatacatttancctagtggtgactaccattatactacgcagactcgtagtgaaggggcctaagttccacctatccgtaccgaagggacaaaccggcccaaagacctcactagtaacctttgactaaaagtcgaaacccnccctagcgacgacccggaggaccgacggtaccgtaattacttacgtgtacggaacgaacggttaaactaccccggttgacccgttagggtttactttaccgg

SEQ ID NO: 317961 - DNA, 608 bp, Homo sapiens
  misc_feature: GZ8MTXP02G9R1H.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatcgacctgggtccgccaggcctccgaggggaacggggctgggaggttgggttccatactatttatcctagtcggtgataccatatactacgcagactcgtgtgaagggccgattcaccatcctaccgagggacaacgccaaagactcactgtactttacgactaaagtcgaaacctacccgtgaccgaacggcccggaaggaccgaacgggtaccgtaattacgttaaccgtggtacgaaccggtaaagtaaaccgttaaacccccggttcgaccccgtttaggggtttaacctttaacccgg

SEQ ID NO: 317962 - DNA, 768 bp, Homo sapiens
  misc_feature: GZ8MTXP02FVX7A.10.79.H02.1.454.CMB.2.raw
  modified_base (330)..(330): a, c, t, g, unknown or other
  misc_feature (330)..(330): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggagggtccctgacgactctcctgtcgcacgcctgtggacttccgccttcgtggattgacttcagtgactactacatacgaccgtcgggtccnccgagggccctaccggaagggggaacggggcgtaggggaggtttggggtttacccaagttactaagtttttactacccgttaggtcgggttgaacttaacctaattaactaacgtacgactaagtacctcgttaggtacggaaacggggtcccgttaacttacccgaaccctaacgttaccccgtacccgaaacgggggaaacccaaaacccggacccgaaaacgaaacccgtttccaaacgttacggtaaacctttacggaacctaaaaagttaccggaaaaccctacccccgtaggacccgaaccggaaccccgggtaacggaaaaccggtcccgggtaaacccgttaaattacgtttaacccggtaggtacgaaacggtaaaccgtaaacccgtttaacccccggttgtaacccgtttacggtttaaccttaccg

SEQ ID NO: 317963 - DNA, 554 bp, Homo sapiens
  misc_feature: GZ8MTXP02JWP34.10.79.H02.1.454.CMB.2.raw
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtccagtgtcaggtgaagctggtggagtcgtgggggaggcttgggtcaagcctgggagggtccctgagactctcctgtgcagcctctggattcgcctntggattgacgttcagtgactactacatgacctgggtccnccaggctcgaggggagggctgggagtggttccatactatttanctagtggtgatacatatactacgcagactctgtgaacgggccattcacctatccacgaggacaacgccaagacncatgtactttgacaaatcgaaacccnccgagcgacgaccgacggaccgacggtctaatacgttacgtgtacgaacgtaacgtaaccgttacccggtcgtaccgtttacgtttacttaccg

SEQ ID NO: 317964 - DNA, 559 bp, Homo sapiens
  misc_feature: GZ8MTXP02I8QWT.10.79.H02.1.454.CMB.2.raw
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (516)..(516): a, c, t, g, unknown or other
  misc_feature (516)..(516): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggccgtgggaggtccctgagactctcctgtgcagcctctggacttcgcctcgtggattgacgttcagtcgactactacatgaccctgggtcccncgacggctaccgaggggacgggctggggaggttggtttccaagtacgtatttactctagtgngtactacatatactacgcagactcgtgagacgggcatcacatcncgagacacgcaaagacncactgtacttagactaaancgaaacncccgtgacgtacgaccggagaccgaccgcgtaatcgtacngtagccgaagtaacctaacccggtctaccgttgtttactaccg

SEQ ID NO: 317965 - DNA, 549 bp, Homo sapiens
  misc_feature: GZ8MTXP02FIVNX.10.79.H02.1.454.CMB.2.raw
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (500)..(500): a, c, t, g, unknown or other
  misc_feature (500)..(500): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggggtcccncagctcgagggaggcnggagtggttcatacattanctagtgtnatacatatactacgcagactntgtagaagggccatcactatcnccgaggacaacgaccaaagactcactgtactttgacaaatcgaaaccacccgtgacgacgaccggaaggaccgaccggaccgtaatacttacgngtagaacgaagaaacgttaacccgtcgaccgttacggtttaacttaccg

SEQ ID NO: 317966 - DNA, 637 bp, Homo sapiens
  misc_feature: GZ8MTXP02GM3P1.10.79.H02.1.454.CMB.2.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (472)..(472): a, c, t, g, unknown or other
  misc_feature (472)..(472): n is a, c, g, or t
  modified_base (588)..(588): a, c, t, g, unknown or other
  misc_feature (588)..(588): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcncgctgngtctcgctgtgtntgtctnagtcactacatgtcgacgtcggccgcgacgccgtacggaggggacggtcgtagggtaggtttcgggttactacgtactttaatttacgtaccgttaggttgggtacgtaacctaactaattaacttaccgtacgacgtaacgtaccttggtaggtacgggaaacgggtcctaacttccaaccgtnttacccgacggaacggaaccaaccgaccgaaacgtacctacacgtagttacgttacaaactaacgtcgaaacctccgagacgacgacggacgaccgtacgtacttaatacgtacgnggtagaacgtaactaacccgttaccggtctacgtttacgtttacttacg

SEQ ID NO: 317967 - DNA, 674 bp, Homo sapiens
  misc_feature: GZ8MTXP02IKQKN.10.79.H02.1.454.CMB.2.raw
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagtcttggtcaagcctggaggtccctgagctctcctgtgcagcctntggattccgcctcgtggattgacgttcagtcgactactacatcgacccgtggggtccncgaggcctccgaggggagggctgggagttgggttcatacctatttacnctagtgtgactacattactactacgctagactcaggttacgaacggggtccctaagtttccaaccctagttcccgtacccggaaggggtaacccaaacggaccctaaaacggaacccttaccaacgtttcggtaaccttttcggaaacctaaaacgtacgaaaacccctcccgttacggaccggaaccggacccgggaagggaaaccccgtacgggtacccgttaattaccgttaacgtggtacgaacggtaacgtaaaccgtttaccccggttccgtaccgtttacggtttaactttaacccg

SEQ ID NO: 317968 - DNA, 631 bp, Homo sapiens
  misc_feature: GZ8MTXP02I8EQR.10.79.H02.1.454.CMB.2.raw
  modified_base (184)..(184): a, c, t, g, unknown or other
  misc_feature (184)..(184): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtntccagtgtcaggtgaagctggtggagtcgtgggggaggcgttggtcaagccgtgggacgggtcccctgagactctcctgtgcagcctctggatccgcctcgtggattgaccgttcagtgactactacatcgaccgtggcccgcaggcctccggaggggagggctggagttggttaccatactatttacnctagtgtnactacattatactacgcagactgtgtaggaagggccctaagttccaaccgtactccgtaccgacggggaacccaaacgaccccgaaaagtaaccctctaaacccgttaggttaacctttacgaaacctaaaagttcggaaaaccctccccgtagacgacggaccggtaggaccacggtaccgttaattacgttaccgtggtacgaacgtacgtaaacgtacccttcgaccgtttacggttaactttaccg

SEQ ID NO: 317969 - DNA, 705 bp, Homo sapiens
  misc_feature: GZ8MTXP02HNKN5.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcattgttgctattataaaaggtgtccagtgtcaggtgaagctggtggagtcgtgggggagcttggtcaagccgtgggacgggtccctggagactctcctgtgcagcctcgtggacttcgcctctggattgacgttcagtgactactacatcgaccgtcgggtcccgccgagggcctccggaaggggaacggggcgtgggaggttcgggtttcagttactatttttactcccgttaggtcggtagtaactacccgtaattactaacgtacgtcaagtacctcgtaggtaggaacgggtcccgtattccacccgtaactcccgtacccgaaggggaacccaaaaccggacccaaaaggtaaccctactaaccgttaacgttacctttaaggaacctaaaacgttacggaaaaccctacccgtaggacccggaaacggccccgggaaagggaaacccaccggggtacccgtattaacgttaacctggttaacgaccgaaacgtaaacccgttaaccccggttcggtaccgtttacggtttaaaccc

SEQ ID NO: 317970 - DNA, 672 bp, Homo sapiens
  misc_feature: GZ8MTXP02JZG5X.10.79.H02.1.454.CMB.2.raw
  modified_base (275)..(275): a, c, t, g, unknown or other
  misc_feature (275)..(275): n is a, c, g, or t
  modified_base (569)..(569): a, c, t, g, unknown or other
  misc_feature (569)..(569): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcttggtcaagccgtgggacggtccctgacgactctcctgtgcagcctctggnttcgcctgtggattgacgttcagtgactactacagtcgaccgtggggtcccgccgaggcctaccggaagggggaacggggtctaggggaggtttcggggttttacccagttaaccttagttttaactcccgttagggttcggtgaacttaaccctaatacgttactacgctaacgaccttcgtggtagggaacgggtccgtatttccgaacctagttccctaccggaacgggaacccaaaccggaccaaaaggtacctacacttaggtactttacgaactaaagtcgaaacccncccgtaggaccgaacggaccggacggaccgaccgggtacctagtacgttacgtgtcgaacgtaagtaaccgttaacccgtcgacgtttacggttactttaccg

SEQ ID NO: 317971 - DNA, 625 bp, Homo sapiens
  misc_feature: GZ8MTXP02G09FA.10.79.H02.1.454.CMB.2.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttggtcaagcctgggacgggtccctggagactctcctgtcgcngcctcgtggnttccgcctcgtggattgacgttcagtcgactactacagtggaccctgggtcccnccgaggcctaccggaaggggacggggctagggtaggttgggttaccagttactattttactccgtaggttgggtgtacttaccgatacgtactacggcaagtctgtggaggaacgggcctaattcacctatcccgtacgaagggaccaaaccggccaaagtacctcaacgttcgtaactttagaactaaagtcgaaaccctccgtcgagaccggaccgaggaccaccggggtcctaagttcctacgtgtacgaacgagtaacctacccgggttcacgtttacggtttacttaccg

SEQ ID NO: 317972 - DNA, 654 bp, Homo sapiens
  misc_feature: GZ8MTXP02JVBG7.10.79.H02.1.454.CMB.2.raw
  modified_base (271)..(271): a, c, t, g, unknown or other
  misc_feature (271)..(271): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtgggacgggtccctgagactctcctgtgcagcctntccggatcgcctctggattgacgttcagtcgactactacatgacccgtggggtcccgccgagggccctaccggaaggggaacggggcttaggggaggttcggggtttaccagttactatttactcgtagtggtnataccatactactacgactagactcgtgtaggaacgggcctaagttccaccctatcctaccgagggaaccaaccgaccaaacgtaccctacaacgttggtaacctttggaacctaaaagtcgaaaccctacccgtgaccgtacgaccgggaacggaccgaccggtaccgttaattacgttaccgtaggtacgaacgtaaacgtaaaccgttaccccggttccgtccgtttaacggtttactttacccgg

SEQ ID NO: 317973 - DNA, 641 bp, Homo sapiens
  misc_feature: GZ8MTXP02J1UNI.10.79.H02.1.454.CMB.2.raw
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggacgggtccctgacgactctcctgtgcagcctnggnttcgcctctggattgacgttcagtgactactacatcgacctgggtcccncgaggcctaccgaggggagggctgggagttgggtttccatacgtatttacncgtagtcggtnaacttaccatatactacgcagactcgtgtacggaacggggcctaattccaccgtatccgtaccgagggaaccaaaccggtccaaaacgacctcaaccgttacggtacctttagactaaaacgtcgaaacccaccccgtggaccgaacggtccccggaaaggacccgtaccggggtaccttaatacttaccgtaggtacgaacgtaaacgtaaccgttaaccccggttccgtaccggtttagttaacctttaaccgg

SEQ ID NO: 317974 - DNA, 659 bp, Homo sapiens
  misc_feature: GZ8MTXP02GI6CF.10.79.H02.1.454.CMB.2.raw
  modified_base (421)..(421): a, c, t, g, unknown or other
  misc_feature (421)..(421): n is a, c, g, or t
  modified_base (455)..(455): a, c, t, g, unknown or other
  misc_feature (455)..(455): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcctgtgctattataaaggtgtcagtgtcaggtgaagctggtggagtcgtgggggaggcttggtcaagcctgggagggtccctgagactctcctgtgcagcctgtggattcgcctctggattgacgttcagtgactactacatcgaccttggggcccgaccgagggcctccggaagggggaaacggggtctggggacggtttggggtttaccccagttactagttttactccgttagtggtgataccattactactacganagactgtagtaggaacgggcctattccaaccgtntcctaccggacggaaccaaccgacgaaacgtaacctccaacgttacgtacttacgaacctaaatccggaaaccttccccgagacccggacgaccgggaacggtaccgtccgggtacccgttaattaacgttaccttggtacggaaaccgtaacgtaaaacccgtttaccccggcgttacccgtttaaggtttacctttacccgg

SEQ ID NO: 317975 - DNA, 557 bp, Homo sapiens
  misc_feature: GZ8MTXP02I1SUB.10.79.H02.1.454.CMB.2.raw
  modified_base (198)..(198): a, c, t, g, unknown or other
  misc_feature (198)..(198): n is a, c, g, or t
  modified_base (329)..(329): a, c, t, g, unknown or other
  misc_feature (329)..(329): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaanagccagctctcctgcagggccagtcagagtctagcagcaactcgttgcctggtaccaacagaaacctggccaggcctcccgggctcctcatctatggtacatctagcagggccacgtggcatcccaggacnggttcaggtcggcaggtggtctgggacagtcttcactctcacatcagtcagtactggagtcgtagaagtagtttgactagtagttatttattgtacagtataagttagttagggtacgtactaccggttggggtactttgggaccgtaggggacctaaggtcgtaggacgtagtaacgaaacgtacgtcggtaggcttacggactaccgtattacctgttctttaccg

SEQ ID NO: 317976 - DNA, 774 bp, Homo sapiens
  misc_feature: GZ8MTXP02FQTJE.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgctattaagtaaaaggtgtccagtgtcgaggtgaagtcgtgggtggagtcggtgggggaggtcgttggtacaagccgtgggacgggtccctgacgactctcctgtcgcacgcctgtggacttccgccttcgtggtattgtaccgttcgagtacgtacctactactagtacccggtaccggtccggccccgaccggaccggtcccgtaccggggaaaggggggaaccgggtcggtaggggttacggggtttacggtttacctaaacgttacgttaactttaccgttacgttagggttgtacgtactaaccgtaattaccgtaaccgtacgactacgtacttgtaggaacggaccggtcttacgtacccacgtctacccgacgggaaacgacccgaaaccaaacgaaacgtacctcgtaccgtacgtttaaccgtacaaacttaaaagacccgaaaccccaccggagaccgtaaccggaacgggaccgaccggtaacccgggttaaacttaagtttaccgtacggttacgaccggaaacgttaaaacccgttaaaccccggtttccccgtcggttaacccggttttaacgtttacccctttacgg

SEQ ID NO: 317977 - DNA, 646 bp, Homo sapiens
  misc_feature: GZ8MTXP02G6N6C.10.79.H02.1.454.CMB.2.raw
  modified_base (270)..(270): a, c, t, g, unknown or other
  misc_feature (270)..(270): n is a, c, g, or t
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggaggcttggtcaagcctgggacggtccctgagactctcctgtgcagcctntggattccgcctctggattgacgttcagtgactactacatcgaccgtgggtcccnccgaggcctccggaaggggaacggggctggggaggttgggttaccatactatttactccgtagtggtgactacatatactacgcagtactctaggtaggaacggggcctattaccacctatcccgtaccgaagggaaccaaaccggaccaaagaccctacacgttagtactttagaacctaaaagtcgaaacctcccgtagaccgacggacccgaacggaccgaccgggtaccgttaattaacgttaccgtaggtacgaacggtaaacgtaaaaccgttaccccggttaccgtacccgtttacggtttaacctttaacccg

SEQ ID NO: 317978 - DNA, 570 bp, Homo sapiens
  misc_feature: GZ8MTXP02JZMRH.10.79.H02.1.454.CMB.2.raw
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
  modified_base (477)..(477): a, c, t, g, unknown or other
  misc_feature (477)..(477): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggatcgcctctggattgacgttcagtgactactacatcgaccgtggtcccgccgaggcctaccgagggtaaggggctggggagttgggtttccatactatttatcctagtggtnataccatatactacgcagactcgtgtaggaacgggccgtattcaccatccncgaggacaacgccaaagactcactgacttgactaatcgaaccnccgtgcgacgccgaggaccaccggaccgtatacttacgtggtagaaccgaacgtaacgttacccgtcgtaccgtttacggtttactttacccg

SEQ ID NO: 317979 - DNA, 610 bp, Homo sapiens
  misc_feature: GZ8MTXP02FTB09.10.79.H02.1.454.CMB.2.raw
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (501)..(501): a, c, t, g, unknown or other
  misc_feature (501)..(501): n is a, c, g, or t
  modified_base (550)..(550): a, c, t, g, unknown or other
  misc_feature (550)..(550): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggaggcttggtcaagcctgggagggtccctgagctctcctgtgcagcctnggatcgctctggattgacttcagtgactactacatcgaccgtgggcccncaggcctcggaggggaacgggcgtggaggttgggttaccagttactaatttactcgtagttggtgactacattataccacgcagtactcgtagtgaacggccgtattccaccctatccctacgaacgggaccaaacgacccaaagtaacctccactagtaaccttgaacaaagtacgaaaccnccgtagacggacgacccggaggaccaccgggtacgtaacttacttacgnggtacgaacggttaaacggaacctaaaccccggttcgtaccgttaggtttactttacccg

SEQ ID NO: 317980 - DNA, 716 bp, Homo sapiens
  misc_feature: GZ8MTXP02H4DH8.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagcgtggtggagtcggtgggggagcgttggtcaagccgtgggacgggtccctggacgactctcctgtgcagcctcgtggactccggcctcgtggtattgacgttcagtcgactactacatcgaccgtcgggccgccagggctaccggaaggggaggggcgtgggaggttggtttaccattactatttatccgtagttcggtgtacttaaccattactaaccgtacgacacgtaccttcgaggtacggaaccggggtccctatttacccaacccgtacttaccccgtaccggaacgggtaacccaaaacggccctaaaacggaacccttacgtaacgtacgttaaccgtttagaaactaaataccggaacctaaaccccgtggaacccggaacgacccggtaaaacggggacccgaaaccgggtacgttaaacttaacggttacctaggtacggaacggtaacggttaaaaccgtaccccggttaccgtaccgtttacggttttaaaccttcccgg

SEQ ID NO: 317981 - DNA, 624 bp, Homo sapiens
  misc_feature: GZ8MTXP02FN2YZ.10.79.H02.1.454.CMB.2.raw
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctntggattcgcctctggattgacgttcagtgactactacatcgacctgggtcccncaggcctccgaggggagggctggaggttggttccattactatttatcctaggttggtgataccatatactacgcagactcgtgtagaacgggccattccaccctatccctaccgaagggaccaaacggacccaaagtaacctccaacgttggtaacctttcggaaccaaaagttccgaaaaccaccccgtggaccgaacggacccggaaggacccgaaccgggtaccttataacttacgtgtacggaacgtaacgtaaaaccgttacccccggttcgtaccgttacggtttactttaacccg

SEQ ID NO: 317982 - DNA, 536 bp, Homo sapiens
  misc_feature: GZ8MTXP02FNK8I.10.79.H02.1.454.CMB.2.raw
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (494)..(494): a, c, t, g, unknown or other
  misc_feature (494)..(494): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccnccaggctccgaggggagggctgggagtgggttccatacatttatctagtggtnataccatatactacgcagactctgtgaagggccattcaccatcctcagggacaaacgccaaagaactcactgtacttgacaaatgaaaccaccctgcgagccgagacacggcctatactacgngtcgcgaacgaactacccggtcgccgttaggttactttaccg

SEQ ID NO: 317983 - DNA, 686 bp, Homo sapiens
  misc_feature: GZ8MTXP02F86U5.10.79.H02.1.454.CMB.2.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattaataaaaggtgtccagtgtcaggtgaagctggtggagtcgtgggggagcgttggtcaagcctgggacgggtccctgagactctcctgtgcagcctntggattccgcctctggacttgacgttcagtgaactactacatcgacctggggtcccncctaggcctaccgaaggggagggctgggtaggtggttccagttctatttactctaggtggtgactaaccgatactacgtacgactagacctgtgtagaaacgggccctaattaccaccctaattcccgtaccgaacggggaaccaaaaccggacccaaaaggaaaccctcctaacttacgtaacctttagaaccttaaaaggtaccaaaaccgtcccctaggaccggtaacgacccggggaaggaaaccccgtacgggggaaccccttaaagtttacgttaaacctggtaacggccgtaaaacgtaaaccggtttaaacccccgttgtaaccccgtttacgggtttaactttaacccgg

SEQ ID NO: 317984 - DNA, 647 bp, Homo sapiens
  misc_feature: GZ8MTXP02JHXXX.10.79.H02.1.454.CMB.2.raw
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaaggcctgggagggtccctgagactctcctgtgcagcctctggattcgctntggattgacgttcagtgactactacatcgacctgggtccnccgaggcctaccggaaggggacggggctaggggaggttgggtttaccatactatttactccgtaggtggtgataccgattactactacgcagactctggtagaacggggcctagttaccacccattcccgtacgacgggaaccaaccgaccaaagtacctcaactcgtactttacgaactaaagttcgaaacctacccgtcgggacgaacgacccgggacggaaaccgacccgggtaccgttaagttaaccgttacgtgtacggaacgtaaacggtaaaccgttaccccggttcgtacccgtttacggtttacgttttaaccccgg

SEQ ID NO: 317985 - DNA, 636 bp, Homo sapiens
  misc_feature: GZ8MTXP02G3N1C.10.79.H02.1.454.CMB.2.raw
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggtcgttggtcaagccgtgggagggtccctgagactctcctgtgcagcctcgtggacttccgcctcgtggattgacgttcagtgactactacatcgacctgggtccncaggctccggaggggagggctgggagttgggttcattacatttacncttaggtgtgactaccattactactagacagtactcgtgtaggaacggggccctaagttacccactacgtccaccgacgggaaccaaaccggccaaaaggaacctcgaccgttagtaacctttagacctaaaagcaaacccgtccccaggaccgacggaccggacggtaaccgaacggcccgttaaattacgtactttaggacgaaccggtaagtaaacccgttaccccggttcgtacccgtttaggttaacctttacccg

SEQ ID NO: 317986 - DNA, 721 bp, Homo sapiens
  misc_feature: GZ8MTXP02I412S.10.79.H02.1.454.CMB.2.raw
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttgcttgttgctattataaaaggtgtccagtgtcaggtgaagctggtggagtcgtgggggagcttggtcaagccgtggagggtccctgagactctcctgtgcagcctcnggactcgcctcnggattgacgttcagtgactactacagtcgacccgtggggtacccnccgaacgggcctacccggagggggtaaacggggtcctaggggtacgttcggggtttaccaagttaacctatttttaactcccgttaaggtgggttagaacttaacccgattaacgtaacctacgcaaagtcctcgtggtagggaacggggtccctaaatttcccaaaccctagttcccgtaccccgaaggggaaacccaaacggaccttaaaacggaaacctccaaccgttcggtaaaccttttggaaaccaaaagttccggaaaacccttccccgaaggcccgaaacggccccggaaaaggacccgtaaacgggtccccttaattaaccgtttacggcgtaacggacgtaaacgtaaacccgtttaccccgttacgtaccgtttaagttttacc

SEQ ID NO: 317987 - DNA, 598 bp, Homo sapiens
  misc_feature: GZ8MTXP02HZ07I.10.79.H02.1.454.CMB.2.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (557)..(557): a, c, t, g, unknown or other
  misc_feature (557)..(557): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggacgggtccctgagactctcctgtgcagcctcgtggattccgcctcgtggattgacgttcagtgactactacntcggaccctgggtcccncgaggctccggaggggacgggctgggagttggttcccattactatttacncctaggtgtgactacatatacctacgntagactctggtagaacggggcctatttaccaacctattccgccgaagggaaccaaaccggaccaaagacttacaactcggtaactttgaactaaagtacgaacctacccgtgaccgacgaccggaggaaccgtacggaccgtaatacgttacgngtacgaacgtactaacgtacccgtgtaccgttagttactcg

SEQ ID NO: 317988 - DNA, 618 bp, Homo sapiens
  misc_feature: GZ8MTXP02FT3CI.10.79.H02.1.454.CMB.2.raw
  modified_base (326)..(326): a, c, t, g, unknown or other
  misc_feature (326)..(326): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagctggtggagtcgtgggggaggtcttggtcaagccgtgggacgggtccctgagactctcctgtcgcagcctctggcttcgcctctggattgacgttcagtgactactacatcgacctgggtccncaggcctccgaggggaggggctgggaggttggttccattactatttacgtcctaggtggtgactacatactactacgcagtactcgtggtacggaacggggcctattccaacctattcccaccggaacgggacaaaccggaccaaagtaacctcactagtactttagacaaaacgtcgaaaccncccgtagacgacgaccggaggaaccgacggtaccgtaattacttacgtggtacgaacgtaacgtaaaccgttaacccgttcgtaccgtttaggtttacctttaaccgg

SEQ ID NO: 317989 - DNA, 701 bp, Homo sapiens
  misc_feature: GZ8MTXP02FJE0H.10.79.H02.1.454.CMB.2.raw
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (630)..(630): a, c, t, g, unknown or other
  misc_feature (630)..(630): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggcaagcctgggagggtccctgagactctcctgtgcagcctctggattccgcctctggattgacgttcagtgactactacatgacccgtgggtcccgcgaggccctaccgagggggaacgggctgggagttgggtttccattacatttancgtagtggtnatacctattatacctacgcagtactcgtagtaggaaacgggtccgtaatttccgaaccctattaccccgtacccggaaacggggaacccctaaaacccgggacccctaaaaaggaacccccttaccgaacctttacgggtaacccttttacggaacctaaaacgttacggaaaaccccaccccgtaggacccggaacggccccggaaagggacccaccggggtacccttaattaacgtttaccgnggttacggaaccgaaaaggtaaacccgttaaccccggttcgtaaccccgtttaggtttaacctttaacccg

SEQ ID NO: 317990 - DNA, 602 bp, Homo sapiens
  misc_feature: GZ8MTXP02ITJ1I.10.79.H02.1.454.CMB.2.raw
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttggtcaaggcctgggagggtccctgagactctccgtgtgcagcctcgtggattccgcctctggtattgacgttcagtgactactacatcgaccgtgggtcccncgaacggctaccggaggggaggggctgggaggtgggttacatactatttancgtagtgtgatacatactactacgacagactcgtgtaggacggccgtaattccaaccactcctaccgagggaaccaaaccgaccaaagacctacacttcgtaactttagactaaaacgtacgtaaaccacccgtgacgacgacccggaggaccgacggtaccgtatacttacgtgtgaacgaacgtaaacgttaccccgtcgtcgttacggtttacttaccg

SEQ ID NO: 317991 - DNA, 611 bp, Homo sapiens
  misc_feature: GZ8MTXP02FHFIQ.10.79.H02.1.454.CMB.2.raw
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
tcagcatagtagtgcacgaccggtgctcgatttagtgtcacacgaagggaaaggggagctctgggagaagagccccagccccagaattccccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctcnggattcgcctctggattgacgttcaggtnactactacatcgaccgtggggtcccgccgaaggcctccgagggggaaggggctggggagttggggtttccagttacatttactccgtaggttggtgactacctattactactacgcagtactctgtagaagggcccattccacctatccgtccgaacggggaccaaaccggccaaaagacctcactgtactttcgacaaatcgaaccacccgtaggaccgacggccgaacgggaccaccggccgtaaatacgttaactggtacgaacgaaacgtaaccgtaaccccgttcgaccttacggttacttacccg

SEQ ID NO: 317992 - DNA, 591 bp, Homo sapiens
  misc_feature: GZ8MTXP02GBOIK.10.79.H02.1.454.CMB.2.raw
  modified_base (322)..(322): a, c, t, g, unknown or other
  misc_feature (322)..(322): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (466)..(466): a, c, t, g, unknown or other
  misc_feature (466)..(466): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctgggagggtccctgagactctcctgtgcagcctctggattcgcctctggattgacgttcagtgactactacatcgaccgtgggtcccnccgaggcctccgaggggagggctgggagtgggttcatactatttanctagtgtgactacatatactacgcagactctgtgaagggccattcaccntcncaggacaacgcaaagactcactgactttacgactaaatcgaaaccncccgtagacgacggacccggaggaccgaaccgggtaccgttaattaacgttaccgtggtacggaacgtaacggtaaaccgttaaaccccggtcggtacccgtttacgggtttaactttaacccgg

SEQ ID NO: 317993 - DNA, 788 bp, Homo sapiens
  misc_feature: GZ8MTXP02GL4EM.10.79.H02.1.454.CMB.2.raw
  modified_base (333)..(333): a, c, t, g, unknown or other
  misc_feature (333)..(333): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctgggtggagtcgtgggggaggcgttggtcaagcctgggacgggtccctgagactctcctgtgcagcctcgtggacttcgcctcgtggtattggacgttcagttgactactactatcgaccgtcgggtcccnccgaggcctacccggaagggggaacggggtccgtagggagggtttcggggtttaccaacgtacttagttttaaccgtccgttaagggttggtacgtaaactaacccgtattaacgttacctaacggcaacgtaacttcgttaggttacggaaaggggtcccgtaactttaccgaccctaattcccgtaccggaaacggggacccaaaaccgggacccaaaacggtaaccctaccgtaacgttacggtaaacttttaacggacctaaaacgggttacgaaaacccctaccgtacgaccggtaaccggaccggggaaccggaaaccgtacccgggggtaacccttaacttttaccgtaaaccgttgttaaccggaaccggttaaaacggtaaacccgtttaaaacccccgggggttcctttacccggtttaacggttttaacccttttaaacccggg

SEQ ID NO: 317994 - DNA, 682 bp, Homo sapiens
  misc_feature: GZ8MTXP02I4M3M.10.79.H02.1.454.CMB.2.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggagcgttggtcaagcctgggacgggtccctgagctctcctgtgcagcctgtggacttcgcctcgtgattgacgttcagtcgacttacacntcgaccgtgggtccncgaggcctaccggagggggaaacggggtctggggtagtttcggggtttaccagttacgtattttacgtccgttaaggttcggtagtaacttaaccctaagtttaacgtaacccttacgacctaagtaacctttcggtaggtagggaaacggggtcccgtaattccgaccctagtccgtaccggacgggaaccaaaccggaccaaaggaacctcaacgttggtaactttacgaactaaaactcgaaaaccgtccccgtaggaccgacggaccggacggaccacgggtacctatacgttacgtggtacgaacggtaacgtaaccgttacccgtcgtacgtttacggttaactttaccgg

SEQ ID NO: 317995 - DNA, 602 bp, Homo sapiens
  misc_feature: GZ8MTXP02JD5LO.10.79.H02.1.454.CMB.2.raw
  modified_base (256)..(256): a, c, t, g, unknown or other
  misc_feature (256)..(256): n is a, c, g, or t
  modified_base (322)..(322): a, c, t, g, unknown or other
  misc_feature (322)..(322): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctgggtggagtcgtgggggaggcttggtcaagcctgggagggtccctgagactcncctgtgcagcctctggatcgcctctggatgacgttcagtgactactacatcgaccgtggggtcccnccgaggcctccggaggggaggggctgggaggttggttccatactatttatcctagtggtgactaccattatactacgacagtactctaggtgaaacggggccgtaattaccacctattccctaccgacggggaacaaaccggacccaaagtaacctcaacgtgtaacttgacctaaatcgaaacacccgtgacgacgacccggaggaaccacggacgtaacttacgttaacctggtagccgtaaggaacttaacccggtgaccttggtttactttaaccg

SEQ ID NO: 317996 - DNA, 544 bp, Homo sapiens
  misc_feature: GZ8MTXP02JMFIW.10.79.H02.1.454.CMB.2.raw
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (468)..(468): a, c, t, g, unknown or other
  misc_feature (468)..(468): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagctctcctgtgcagcctctggattcgcctctggattggacgttcagtgactactacatcgacctgggtcccnccgaggctccgaggggaggggctgggagttgggtttccagtactntttacncctagtggtgataccatatactacgcagactctgtgaagggccgatcaccatcncgaggacaacgccaagactcactgtacttgactaaatcgaacnccctgcgacgccgaggacacggacgtatactactgtcgaacgacgaactacccgtcgaccgttcggttacttaccg

SEQ ID NO: 317997 - DNA, 626 bp, Homo sapiens
  misc_feature: GZ8MTXP02GHPZL.10.79.H02.1.454.CMB.2.raw
  modified_base (193)..(193): a, c, t, g, unknown or other
  misc_feature (193)..(193): n is a, c, g, or t
  modified_base (327)..(327): a, c, t, g, unknown or other
  misc_feature (327)..(327): n is a, c, g, or t
  modified_base (494)..(494): a, c, t, g, unknown or other
  misc_feature (494)..(494): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtnaggtgaagctggtggagtcgtgggggagtcttggtcaagccgtgggacggtccctgagactctcctgtgcagcctcgtggattccgcctcgtggtattgacgttcagtgactactacatcgaccgtcgggtccnccgaggccctccggaggggagggctgggagttggttccattacgtatttactctaggtgtgatacatatactagcagacctgtgtagaaggccattacactatctaccgagggaaccaaccgccaaagaacctcacgtagtacgtttacgacaaagttaccgaaccnccccgtaggaccgacgacccggaagggaacccaccggggtaccttaaagtttactaacggttcgacggaaccgtaaacgtaaaaccgtttaacccccggttcgtacctttacgggtttaactttaaccccgg

SEQ ID NO: 317998 - DNA, 613 bp, Homo sapiens
  misc_feature: GZ8MTXP02IXSAG.10.79.H02.1.454.CMB.2.raw
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggaggtcgtggggggaggtcttggtcaaggccgtgggagggtccctggacgacttctcctgtgcagccctcgtggacttcgccttctggattcgacgttcagtgacctactactatcgaccgtggggtccnccgaggcctccgaggggagggctggaggtcggttcatactattactctagtggnataccatatactacgctanctntggagaagggccgtattcacctatccgtaccgacggaacaaaccgaccaaagacctactactagtactttagaacaaacgtacgaaacctacccgtagacgacggaccggacggaccgaaccggtacgttaactacgttacgtgtacgaaccgaaagtaaccgtacccggttcgaccgtttacggttactttaaccgg

SEQ ID NO: 317999 - DNA, 570 bp, Homo sapiens
  misc_feature: GZ8MTXP02FKZ5Y.10.79.H02.1.454.CMB.2.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggtcgttggtcaagccgtgggagggtccctgagactctcctgtgcagcctntggattcgcctctggattgacgttcagtgactactacatcgaccgtgggtcccnccgaggcctccggagggggaacggggtctgggaggttgggtttaccagttactatttactcgtagtggtgataccatactacacgcagtactgtgtaggaagggcctattcaccatcaccgaggaccaacgccaaagactcactgtacttgaactaaatcgaaccaccctgaccgagccgaggacacggctatactactgtacgaacgtaacgaacttacccgtgaccgttggttacttaccg

SEQ ID NO: 318000 - DNA, 715 bp, Homo sapiens
  misc_feature: GZ8MTXP02IBUNM.10.79.H02.1.454.CMB.2.raw
  modified_base (655)..(655): a, c, t, g, unknown or other
  misc_feature (655)..(655): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgcttattaagtaaaaggtgtccagtgtcaggtgaagcgtggtggagtcgtggggggagtcgttggtacaaggccgtgggacgggttccctggacgtacctctccgtgtcgcacgcctcgtggtacttccggcctcgtggtattcggacgttcgagtcgactactacagtcgaccgtgggtccccgacgaggccgtaccggaaggggacgggtctaggggtagtttgggttaccagttacctatttactcgttaggtgtcgtaactaccaattaactacgtacgctaacgtccttcgtaggtacggaacggtccgtaatttcgacttacactaccgttacccgaaacggggtaaaccaaacccgtaacccgaaaagtaacctaccaacgttacgtaccgtttaagaaaccttaaaagtccgaaaccctacccgaggaccgacgaccgggtacggaaccgtacgggtaccttaattacgtttaacgnggttaacggacgtaaacgtaaccgttaaccccggtttcgaccgttttacggtttaacccg

SEQ ID NO: 318001 - DNA, 676 bp, Homo sapiens
  misc_feature: GZ8MTXP02JTYWZ.10.79.H02.1.454.CMB.2.raw
  modified_base (423)..(423): a, c, t, g, unknown or other
  misc_feature (423)..(423): n is a, c, g, or t
  modified_base (570)..(570): a, c, t, g, unknown or other
  misc_feature (570)..(570): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaagccgtgggacgggtccctgagactctcctgtgcagcctcgtggacttcgcctcgtggattgacgttcagttgactactacagtcgaccgtggggtcccgccgagggccctacccggaagggggtaacgggggcctaggggacggtttggggtttaccagttacctagtttttactccgttaaggttgggtntaacttaccgattataccgtacgctaagtactcgtaggtagaaacggggcctagttcaccctagtcctaccgaggggaaccaaaccggccctaaaaggacccttacaacgttacggttacctttacgaactaaatccggaaaacccncccgtagaccgacggaccggaacggaccgaccggtccttaacttacgttacgtgtacgaacgtaacgtaaaccgttacccgtcgtacccgtttagtttacttaccg

SEQ ID NO: 318002 - DNA, 561 bp, Homo sapiens
  misc_feature: GZ8MTXP02JKMTP.10.79.H02.1.454.CMB.2.raw
  modified_base (324)..(324): a, c, t, g, unknown or other
  misc_feature (324)..(324): n is a, c, g, or t
  modified_base (375)..(375): a, c, t, g, unknown or other
  misc_feature (375)..(375): n is a, c, g, or t
  modified_base (482)..(482): a, c, t, g, unknown or other
  misc_feature (482)..(482): n is a, c, g, or t
  modified_base (522)..(522): a, c, t, g, unknown or other
  misc_feature (522)..(522): n is a, c, g, or t
  modified_base (544)..(544): a, c, t, g, unknown or other
  misc_feature (544)..(544): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggacttcgcctctggattgacgttcagtcgactactacatcgacctggggtccnccaggcctccggaggggaggggctgggaggttgggttccatactatttacncgtagtggtgactaccatactactacgcagacctcgtggtagaacgggcctattcacctatccaccgaggacaacgccaagactcatcgtacttgacaatcgaaccnccgtagccgagcccgaggacacggaccgttatacttacgngacgcgaacgaacttacccgtnccgttagttactttacg

SEQ ID NO: 318003 - DNA, 775 bp, Homo sapiens
  misc_feature: GZ8MTXP02JKEM2.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgctattaataaaaggtgtccagtgtcaggtgaagcgtggtggagtcgtgggggagtcttggtcaagccgtgggacggtccctgacgtactcgtcctggtgcagtcctcgtggtacttcgccttcgtggtattggtacgttcagtgaactacctatagtcggtacccgtcggggtcccaccgagggtccctaccgggaagggggtaaccggggtcgtaggggtacggtttgggtttacccaagttaacgttattttacgtaccgttaggtagggtgtaactaaacctaattataaccgtacggactaacgtacccttgttaggtaacgggaacgggtcccgtaacttacccacccgtacgttacccgacgaccgggggaaaccaaaccggacccgtaaaaggaccctaccgtaacgttacggttaaactttacggaaacctaaaacggttaccaaaacccgtcccccgtaagggaacccgtaacgggaacccggggaacggaacccggtaaccggtacccgttaaagttacgtaccgtaggtacggtaacgtaaacgtaaacccgttacccgttaccgtaccggtttcggtttaactttacccgg

SEQ ID NO: 318004 - DNA, 611 bp, Homo sapiens
  misc_feature: GZ8MTXP02JAB7O.10.79.H02.1.454.CMB.2.raw
  modified_base (325)..(325): a, c, t, g, unknown or other
  misc_feature (325)..(325): n is a, c, g, or t
  modified_base (495)..(495): a, c, t, g, unknown or other
  misc_feature (495)..(495): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttgggtcaagcctgggacgggtccctggagcttctcctgtgcagcctctggattccgcctcgtggattgacgttcagtgactactacatgacctgggtcccncgaggcctccgaggggaggggctgggagttcgggttcagtactatttatcctagttgtgtactacattatacctagacagtactcgtagtgaacggggcctagttccaccatcctacgaggaccaaacgaccaagaactcactgtactttagacctaaagtacgaaaccncccgtacgcgaacggccggaacgacgaaccgggtaccgttaatacgttacctaggtacgcggtaaaacgtaaccttaaacccggtccgtacccgtttcggtttaacctttacccgg

SEQ ID NO: 318005 - DNA, 617 bp, Homo sapiens
  misc_feature: GZ8MTXP02GP5N6.10.79.H02.1.454.CMB.2.raw
  modified_base (324)..(324): a, c, t, g, unknown or other
  misc_feature (324)..(324): n is a, c, g, or t
  modified_base (380)..(380): a, c, t, g, unknown or other
  misc_feature (380)..(380): n is a, c, g, or t
  modified_base (513)..(513): a, c, t, g, unknown or other
  misc_feature (513)..(513): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagtcgttggtcaagcctgggacggtcctgagtactctcctgtgcagcctctggacttcgcctctggattgacgttcagtgactactacatgaccgtcggtccncaggctaccgaggggagggctaggagttggttaccatactattactctagtgggtnatacatactacgtaacgctaagacttctaggtacgaacgggcctaattccaaccattccgaccgaaaggggaaccaaaccggacccaaaagtaacctacacttacgtaactttacgactaaaagtcgaaaacncccgtagacgccgaacgaccggtaacgacggtaccgtacgtaataacgtcgtagaaccgtaagtaaccgtaacccgttaccgtaccttacggtttactttaacg

SEQ ID NO: 318006 - DNA, 599 bp, Homo sapiens
  misc_feature: GZ8MTXP02JTVM6.10.79.H02.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
  modified_base (492)..(492): a, c, t, g, unknown or other
  misc_feature (492)..(492): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctgggagggtccctgagactctcctgtgcagcctntggattcgcctctggattgacgttcagtgactactacatcgacctgggtccnccaggcctcgaggggagggctgggagttgggttaccagtactatttacnccttaggtggtgactaccattatacctacgcagactcgtagtaggaacggggccctattccacccattcctaccgagggaccaaacggcccaaagactcatgactttgaccaaatcgaaacccnccgtgaccgacggaccggaacggaccgacgggtaccttaatacgttacgtggtacgaacgtaacgtaacccgttacccggttcgtaccgtttacggtttacttaccg

SEQ ID NO: 318007 - DNA, 731 bp, Homo sapiens
  misc_feature: GZ8MTXP02JA206.10.79.H02.1.454.CMB.2.raw
  modified_base (677)..(677): a, c, t, g, unknown or other
  misc_feature (677)..(677): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagcgtggtggagtcgtgggggagcgttggtcaagccgtgggacgggtccctgagacctctcctgtcgcagcctcgtggacttccggccttacgtgggtactttcggaccgtttcgagttcgaacctttactactaagttccggacccgttcggggtccccgaccgtacgggtacccgtaccgggaagggggaacggggtccgttaggggtaggtttcggggtttacccaagttaccgttaagtttttacgtccgttaaggttgggttacgtaaacttaaccgtattaacttaccgtacgacgtacgtactgtaggtacggaacgggtcctattaccgaccctataccgaccgaaacggaccaaaccgaccgtaaaagacccttacacgttacggttaacctttacgaactaaaagtccgaaaacctcccgagacccggacgaccggaggaccgacggtactaagttacgttaccggngtacgaacgtaacgtaaccgttacccggttgtaccgtttacgtttaccttaccg

SEQ ID NO: 318008 - DNA, 663 bp, Homo sapiens
  misc_feature: GZ8MTXP02FS7FI.10.79.H02.1.454.CMB.2.raw
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
tcagcatagtagtgcacgaccggtgctcgatttagtgtcacacgaaggggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggagggtccctgagactctcctgtgcagcctcnggattcgcctctggattgacgttcagtgactactacatgacctgggtcccncgaggctaccgaggggacgggcgtggaggttgggtttaccattacctatttactccttaaggtggtgaactacctaatactactacgcagactctaggtacggaacggggccgtattaccacctatccgtaccgaacgggacaaaccggaccaaacgtaactaccaaccttaggtaacctttcgaactaaaactacgaaacccacccgttagacccggaacggacccggacggaaccgaacccgggtacgtaaacttaacgttaacgtcggttacggaacgtaaacggtaaaaccgttaacccccgttacggtacccgtttagggtttaactttaacccgg

SEQ ID NO: 318009 - DNA, 803 bp, Homo sapiens
  misc_feature: GZ8MTXP02JXIPN.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtgggttttccttgttgctattataaaaggtgtccagtgtcaggtgaagcgtgggtggaggttcggtggggggaggtcgttgggtacaaggtccgtggggacgggtccctaggacgtaccttcctcctgtcgcacggtcctcgtggcttccgccttcgtggtattggtacgttcagttcgacctactacatcggtaccgtcggggtcccgccgacgggcccgtaccggaagggggtaacggggtcgtaggggtacggttagggtttaccgaattaccgttattttacgttccgttagggtgggttacgtaactaaccctaagttaactaccgtaaccggactaacggtaccttccgttagggtaacggggtaacgggggtccctaaacgtttcccaaccctacgttcccgtaacccggacggggaaacccaaacccgggacccaaaacggtaaaccctctaaccgtacgttaacgtttgaaaccgtaaaactaccgaaaccctacccccgtggacccgaacgggacccggaacggtacccggaaaccggggtacctttaaagttacttaacggtcggtaaggaacccgttaacggtaaacccgttaccccggttacgtcccgttttaagggtttaaccctttaacccgg

SEQ ID NO: 318010 - DNA, 591 bp, Homo sapiens
  misc_feature: GZ8MTXP02G3P0E.10.79.H02.1.454.CMB.2.raw
  modified_base (261)..(261): a, c, t, g, unknown or other
  misc_feature (261)..(261): n is a, c, g, or t
  modified_base (490)..(490): a, c, t, g, unknown or other
  misc_feature (490)..(490): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcngcctctggattcgcctctggattgacgttcagtgactactacagtgacctgggtccgccgaggcctccggaggggaggggctgggagttgggttccatactattatctagtgtgactacatactactacgcagtactctaggtagacggggcctattaccgacctatcccgtaccgagggaccaaacggaccaaagaacctcactgtacttagactaaagtcgaaaccncccgtagaccgacgacccggaggaaccgaccgggaccgtaattacgttaacgcgtacgaacgaacgtaaccgtacccgtacgtacgttacgtttacttacg

SEQ ID NO: 318011 - DNA, 722 bp, Homo sapiens
  misc_feature: GZ8MTXP02IZF3I.10.79.H02.1.454.CMB.2.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (255)..(256): a, c, t, g, unknown or other
  misc_feature (255)..(256): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtaggctataataaaggtgtcagtgtcagtgaagctggtggagtcgtggggagtnttggtnaagcgtggacggtccngagctctctgngcnnctgtgctcgctgtgtattcgtacgtgacgtcgtactactactagtccgaccggtccggccgccgtaggtacccgtacgggaagggggtacgggtcggttaggggtacgggttacgttacctaacgtttaaccgttacgtttaccgtacggttaggtagttagtaaccttaaactaagttaaccgtactaacgacttacgtacgttagtacggtacggaaacggtaccgtaacgtaccgtaacctaccgtaccgtaacgaaacggaaaccgtaaaccgaaacccgaaagtaaccgtacctaacgttaagttaacgttaacaacgtaaacgtaacgtaaccgtaccgtaccgacggaccggaaccggaaccggtaaccggtaaccggtaacgttaacgttaacgttacgtacgtacgtaacgtaacgtaaccgttaaccgttaccgttaccgttacgtttacgttacg

SEQ ID NO: 318012 - DNA, 548 bp, Homo sapiens
  misc_feature: GZ8MTXP02FKKCP.10.79.H02.1.454.CMB.2.raw
  modified_base (387)..(387): a, c, t, g, unknown or other
  misc_feature (387)..(387): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (511)..(511): a, c, t, g, unknown or other
  misc_feature (511)..(511): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggccttgggagggtccctgagactctcctgtgcagcctctggattcgcctctggattgacgttcagtgactactacatgacctgggtccgccgaggcctccgaggggaaggggctgggaggtggggtttccatacatttatcctaagtcgggtnactaccatatactacgcagactctgtgaacgggcgattcaccatcncaggacaacgcaaagacncactgtactttgacaaatcgaacaccctgacgacgccgaggacacggcctactacttacngtagcgagaactacccgtcgcgtacgttactttaccg

SEQ ID NO: 318013 - DNA, 544 bp, Homo sapiens
  misc_feature: GZ8MTXP02I3AAC.10.79.H02.1.454.CMB.2.raw
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (501)..(501): a, c, t, g, unknown or other
  misc_feature (501)..(501): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagccgtggagggtccctgagactctcctgtgcagcctctggatcgcctcgnggattgacgttcgagttgactactacagtggaccgtgggtccgccgaggcctcgagggagggctgggagttggttccagtcatttatcctagtggtgataaccgatanactagcagactctgtgaacgggcattcacctatcctcagggactaacgcaaagactnactgacttganaatgaaacncctgcgagccggagtaccacggcgtatcgttacgngtacgaacgaacgaaccgttacccgtcgtactacgtttactcg

SEQ ID NO: 318014 - DNA, 642 bp, Homo sapiens
  misc_feature: GZ8MTXP02GPFDT.10.79.H02.1.454.CMB.2.raw
  modified_base (277)..(277): a, c, t, g, unknown or other
  misc_feature (277)..(277): n is a, c, g, or t
  modified_base (408)..(408): a, c, t, g, unknown or other
  misc_feature (408)..(408): n is a, c, g, or t
  modified_base (541)..(541): a, c, t, g, unknown or other
  misc_feature (541)..(541): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctggtggagtcgtgggggagcttggtcaagccgtgggacgggtccctgagactctcctgtgcagcctgtggnttcgctcgtggattgacgttcagtcgactactacatcgaccgtgggtcccgcaggccctaccggaagggggaacggggtctggggtaggttcgggtttacagttactattttacgtccgttaggttgggtnacttaaccattacttaccgtacgcaagtacctcgtaggtaggaacggggcctacttcacctattcccgaccgagggacccaaacggaccaaacgacctcaactggtaacctttgaacctaaagtacgaaaccncccgtagccgtacgaccggacgacgacggtacgttatacgttacgtggtacgaacgtaaagtaaaccgttacccggttcgaccgtttacgttactttaccg

SEQ ID NO: 318015 - DNA, 958 bp, Homo sapiens
  misc_feature: GZ8MTXP02G3LX8.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggaggtccctgagactctcctgtgcagcctcgtggacttcgcctcgtggtattgacgttcagtgactactacatcgaccgtgggtcccgccgacgggccctacccggaagggggaaggggccgtaggggtaggtttggggtttacccaagttaccgtattttaactcccgttaaggttcgggtacggtaacttaaccccgtaagtttaaacgttaacccgtaacgggtacctaaacggttaaacccgttcgttaacggggttaacggggaaaccgggggccccgttaacgttttaacccggaaccccctaacgtttacccccgttaaccccgggaaaacgggggtaaacccaaaaacccccggggacccccttaaaaaacgggaaaaccccctttaccgtaaaccccggttttaacgggttaaaccctttttaacggggaaaacccttaaaaacggttaacccggaaaacccccgttaaccccccggttagggggaacccggggtaaaaccccgggggaccccccgggggggtaaaacccggtacccccgggggtaaacccccgggtttaaaatttaacccggtttttaccggtacgggtttaccgggaaaccggggtaaacgtttaaaaacccccggtttaaaacccccgggttttccccgggaacccggtttttacgggggtttttaaaaccccttttaccccggttttaaacccgggg

SEQ ID NO: 318016 - DNA, 559 bp, Homo sapiens
  misc_feature: GZ8MTXP02JYCZ1.10.79.H02.1.454.CMB.2.raw
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctggtccgcaggctcgagggagggctggagttggttcatcagtttacncgtagtgtgataccatatactacgnagactctgtgaagggccattcaccgatcctacgagggaccaacgccgaaacgacctcactgactttgactaaatgaaccacccgtgaccgagccggaaacggacgaccggacgttactacgtacgtacgtgaacgaacgtaaccgtaacccggttgcccgtttaggttactttaccg

SEQ ID NO: 318017 - DNA, 650 bp, Homo sapiens
  misc_feature: GZ8MTXP02H2O0I.10.79.H02.1.454.CMB.2.raw
  modified_base (348)..(348): a, c, t, g, unknown or other
  misc_feature (348)..(348): n is a, c, g, or t
  modified_base (421)..(421): a, c, t, g, unknown or other
  misc_feature (421)..(421): n is a, c, g, or t
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
  modified_base (559)..(559): a, c, t, g, unknown or other
  misc_feature (559)..(559): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggagtcgttggtcaaggccgtgggacgggtccctggacgtactcttccgtggtgccgacgcctcgtggactccgcctcgtggtattgaccgttcagtcgaactactactatcgacccgtgggtcccncgaggccgtaccggaaggggacgggcgttagggacggttggttacccagttaactatttactcgtaggtggtntaactaacattactactacgatacgacttcgnggtaggaacgggccctagttaccaacctntccgaaccggacggaaccaaaccgaccaaagacctacaacgtcgtaacttgaaacaaagttccgaaaccctacccgngaccgacgaccggacggacctacggtacttatacgtacgtgacgaaccgtaacgtaacccgttacccgttcgtaccgtttacgttacctcg

SEQ ID NO: 318018 - DNA, 711 bp, Homo sapiens
  misc_feature: GZ8MTXP02HCT9J.10.79.H02.1.454.CMB.2.raw
  modified_base (656)..(656): a, c, t, g, unknown or other
  misc_feature (656)..(656): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtgggtggagtcgtggggggagtcgttggtcaagcctgggacgggtccctggacgactctcctgtgcagcctctggacttcgcctctggattgacgttcagtcgacttactacagtcgaccgtcgggtcccgccgacggcctccggaggggacgggcgttgggtacggttcgggttacctagtacgttatttacgtacttaggttcggtcgtaacttaaccgtattacgtaaccgtacgactaacggtaaccttcgtaggtacgggaaacggggtccctattccgaacctagttacccgaccgaaaacggggacctaaaacccggaccgaaaacggtaacccttaccgaacgtttacgtaacctttacggaaacctaaacgttacgaaacccgtacccgtggaccgtaaccggccggtaacggaccgaccgggtaccttaattacgttaccgngtacggaaccgtaaacgtaaccgttacccggttctaccgtttacgtactttaccg

SEQ ID NO: 318019 - DNA, 611 bp, Homo sapiens
  misc_feature: GZ8MTXP02F93O4.10.79.H02.1.454.CMB.2.raw
  modified_base (551)..(551): a, c, t, g, unknown or other
  misc_feature (551)..(551): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcttggtcaagccgtggagggtccctgagactctcctgtgcagcctctggattcgcctctggattgacgttcagtgactactacatgaccgtgggtcccgccgaggcctccgaggggaaggggctgggagtgggttaccagtactattatcctagtgtgataccatatactacgcagtactcgtgtacgaacgggccgtagttaccacctatcccgtaccgaacgggacaaccggaccaaaggaccttcactggtactttagacaaatcgaaacctacctcgacgacgaccgacggaacgaccgggtaccgtaaacttacgtttaccgngttacgcggtaaagtaaacccgttaacccgttcgtaccgttacggtttacctttaaccgg

SEQ ID NO: 318020 - DNA, 773 bp, Homo sapiens
  misc_feature: GZ8MTXP02HI4G1.10.79.H02.1.454.CMB.2.raw
  modified_base (187)..(187): a, c, t, g, unknown or other
  misc_feature (187)..(187): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgctattaataaaggtntccagtgtcaggtgaagctgggtggagtcgtgggggagtcgttgggtcaaggccgtgggacgggttcccctggacgtaccgttctccgtggtgccaggtccctcgtggacttccggcctcgtggtattgtacgttcagtcgtaactactacagtcggtacccgtggggtccccaccgacgggtcctacccgggaagggggaaacggggtcgtaggggtaggtttcgggttacccaagttacttacttttacgttacccgttaaggttcgggtagtaaccttaacctaaattacgtaaccgttacgacacgtaccttcgtggtaacggaacggggcccttaaagttcccaacctacgttcccgaacccggaacggggaaacccaaacccggtaacccaaaacggtaaaccttacccaaacgtttacccggtaaatttacggaaaactaaacgttaaccgaaacccctacccgtagaaccggacggacccggaacgtacccgaccggttacccgtaaattacgtacctggacgtaacgtaacgtaaaccctttaccccggtctacccgtttaggtttaccttacccgg

SEQ ID NO: 318021 - DNA, 788 bp, Homo sapiens
  misc_feature: GZ8MTXP02JYCB4.10.79.H02.1.454.CMB.2.raw
  modified_base (342)..(342): a, c, t, g, unknown or other
  misc_feature (342)..(342): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggagtcgttggtcaaggccgtgggacggtccctgacgctctcctgtgcagtcctcgtggacttcgcctgtggtattgtacgttcagtcgacttactactagtcggaccgtcggggtccccnccgacggcctaccggaaggggaacgggtcgttaggggtaggtttcgggttacccattacttatttacgtccgttaggttcgggtgtaacttaacccgtaattaacgtaccgtaacgacgtaacgtaccttcgttaggtacgggaaacggggtcccttaattaccccaaccgttacgtttaccccggtaccggaaaacggggttaacccaaaacccgggccctaaaaaacgggtaccctttaccaacggtttacggttaaacctttacgaaaacccgttaaagttacccgaaaaccccgtcccgtagggaaccccgggaaacggaccccgggtaaaacggacccgtaccgggttaaccttaatttaacgtacccgtaggtacggaacggtaaaccgttaaacccgttacccggtttcgtaccgttttaaggttacccttttaaccgg

SEQ ID NO: 318022 - DNA, 559 bp, Homo sapiens
  misc_feature: GZ8MTXP02H7W4U.10.79.H02.1.454.CMB.2.raw
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (477)..(477): a, c, t, g, unknown or other
  misc_feature (477)..(477): n is a, c, g, or t
tcagcatagtagtgcacgaccggtgctcgatttagtgtcacacgaagggaaaggggagctctgggagaagagcccccagccccagaattcccaggagtttccattcggtgatcagcactgaacacagaggactcaccatggagtttgggctgagctgggttttcctgttgctattataaaggtgtccagtgtcaggtgaagcgtggtggagtcgtgggggagcgttggtcaagccgtggacgggtccctgagactctcctgtgcngcctgtggattccgccttcgnggtattggacgttcagtcgactactacatcgaccgtggtccgcaggctccggagggaggctgggagttggtccagtactattactctaggtgtgactacatacgactacgntagctcngtgaacggccattcaccatcacgagacacgcaaagactatcgtagacttagaactaagtccgaactacccggngacgacgacgacggacgacgtactagtactacgtgacgaacgtaacgtaaccgttccgtacgtccgtttacggtttactccg

SEQ ID NO: 318023 - DNA, 641 bp, Homo sapiens
  misc_feature: GZ8MTXP02JWF58.10.79.H02.1.454.CMB.2.raw
  modified_base (198)..(198): a, c, t, g, unknown or other
  misc_feature (198)..(198): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtnaagctggtggagtctgggggaggcttggtcaagcctggagggtccctgagactctcctgtgcagcctctggacttcgcctctggattgacgttcagtgactactacatgaccgtggtccgccaggcctaccgaggggaacggggcgtagggagtggggtttccattacatttatcctaggtggtgactaccattatactacgcaagactctaggtgaacgggcccgaattccacccatcccgtaccgaacgggggaaccaaacgacccaaaagacctaccgaactacggtacttttagaactaaaatcgaaaccctaccccgagggacgaaccggaccgaacgggaacccgaccgggacccggttaaattaacgttacgtcgtacggtaacgaagtaaaccttaaccccggttccgtacccgttaggtttaacctttaacccg

SEQ ID NO: 318024 - DNA, 602 bp, Homo sapiens
  misc_feature: GZ8MTXP02JIRPC.10.79.H02.1.454.CMB.2.raw
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (399)..(399): a, c, t, g, unknown or other
  misc_feature (399)..(399): n is a, c, g, or t
  modified_base (560)..(560): a, c, t, g, unknown or other
  misc_feature (560)..(560): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtctgggtgaggtcttggtcaagccgtggacgggtccctgagactctccgtgtgcacgcctcgtggtacttccgcctctggattgacgttnagtnactactacatcgacctgggtcccnccgaggcctaccggaggggaacggggctaggggagttcgggttcagttactatttactccgtagtgggtnataccattactacgtacgctagactctaggtagacgggtccctattccacccatcccacgagggtaaaccaccgaccaagacctctactgtacctttaggaactaaagtacgaaccctccgtcgacgacgaccggagacgaccggtacgttatacgttacnggtaagacgaagtaacgtaccccgtgtcgttacggtttaacc

SEQ ID NO: 318025 - DNA, 601 bp, Homo sapiens
  misc_feature: GZ8MTXP02HMVI3.10.79.H02.1.454.CMB.2.raw
  modified_base (185)..(185): a, c, t, g, unknown or other
  misc_feature (185)..(185): n is a, c, g, or t
  modified_base (331)..(331): a, c, t, g, unknown or other
  misc_feature (331)..(331): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (474)..(474): a, c, t, g, unknown or other
  misc_feature (474)..(474): n is a, c, g, or t
  modified_base (508)..(508): a, c, t, g, unknown or other
  misc_feature (508)..(508): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttcctgttgctattataaaaggtntccagtgtcaggtgaagcgtggtggagtcgtgggggagtcttggtcaagccgtgggaggtccctgacgactctcctgtgcagcctgtggacttcgcctcgtggtattcgacgttcagtcgactactacagtcggaccccgggtccnccgaggcctaccggaggggagggcgtgggagttggttcatactatttcnctagtgtanactacctatactacctagcacgtactcgtgtaggacggcgtattaccacgtctctaccgaagggaccaaaccggccaaagtaccnctacgtgtacttgaactaatacgaactacccggngaccgacgaccgacgtaccgacggtacctattacgtcgtacgtacgacgtaacgtaaccttacccgttcgtaccgtttacgttacttaccgtg

SEQ ID NO: 318026 - DNA, 633 bp, Homo sapiens
  misc_feature: GZ8MTXP02F0J7K.10.79.H02.1.454.CMB.2.raw
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
tcagcatagtagtgcacgaccggtgctcgatttagtgtcacacgaagggaaaggggagctctgggagaagaggccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaagcctgggacgggtccctgagactctcctgtgcagcctgtggacttccgcctcgtggtattgtacgttnagtgactactacagtcgaccgtgggtcccnccgaggcctccgagggggacgggctggggaggttgggttaccattactatttactccgtaggttggtgactaacctattactacgtacgcagtacttgtaggtaggaacggggccctattccacctatcccgtaccgagggaccaaccgaccaaagacctcgacttcgtactttagactaaatcgaaacctcccgagaccgacgacccggaaggacccacgggtaccttaattacgttaccgtgtacgaacggtaactaaccgttaccccggttcgtaccgtttcggtttaactttacccgg

SEQ ID NO: 318027 - DNA, 623 bp, Homo sapiens
  misc_feature: GZ8MTXP02HTZOE.10.79.H02.1.454.CMB.2.raw
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggacgggtccctgagctctcctgtgcagcctctggattccgcctctggattgacgttcagtgacctactacntgacctggtccgcgacggctccgaggggagggctaggngtggttccatactnttatctagtgtgatacatntaactacgcacnctctaggtacggaacgggccgtattaccaccctactcccgtaccgacgggaaccgaaaccgacccgaaagtaaccctccgtaacttacggtaaccttttggaactaaaacgttacgaaacccacccgtaggaccgacggaccgaaggaccgacccgggacgttactaacgtttacctggtcgaacgaaggtaacctaacccgttcgaccgtttacggtttactttaacccgg

SEQ ID NO: 318028 - DNA, 665 bp, Homo sapiens
  misc_feature: GZ8MTXP02FRNYX.10.79.H02.1.454.CMB.2.raw
  modified_base (328)..(328): a, c, t, g, unknown or other
  misc_feature (328)..(328): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
  modified_base (597)..(597): a, c, t, g, unknown or other
  misc_feature (597)..(597): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggacgggtcctgagactctcctgtgcagtcctcgtggattccgcctgtggattgacgttcagtgactactacatcgaccgtcgggtacccncgaggaccgtaccgagggggaacggggtctggggaaggtttggggtttacccagttaccgtaatttactaccgtaaggttggtagtactaaaccgtatacttaaccgtaacgcaagtacttcgtaggtacgaaagggcctattacccacattccaccgagggaaccaaacgacccaaaagtactcaactataccgtttanacaanaccgaaaccnccgagaccgacgacccggtaaggaccgaaccggtacttaacttaacgtttacgnggtacgaacgtaaaccgttaaacccgttaccccggtcgttaccgtttaacggttttaacccttaccgg

SEQ ID NO: 318029 - DNA, 656 bp, Homo sapiens
  misc_feature: GZ8MTXP02FJW6P.10.79.H02.1.454.CMB.2.raw
  modified_base (277)..(277): a, c, t, g, unknown or other
  misc_feature (277)..(277): n is a, c, g, or t
  modified_base (604)..(604): a, c, t, g, unknown or other
  misc_feature (604)..(604): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtggggggaggctttgggtcaaggcctgggacgggtccctgacgactctcctgtgcagcctntggattcgcctctggattgacgttcaggtgactactacagtcgacccgttggggtcccgccgagggtcctaccggaaggggggaaacgggggcctggggaggtttggggtttcccaagttacctatttacgtccgttaggttgggtgactaaccgtattactaccgtacgcaagtactctgtaggaacggggcctagttacccacctactccgtaccgacggaacaaaccggaccaaagaacctacgacttagtacctttagaactaaatacgaaaccacccgtgaccggacgaccggaggaccaccggtacgtaacttacttacgngtacggaacgtaactaaccgtacccgttcgtaccgttaggttactttaaccg

SEQ ID NO: 318030 - DNA, 605 bp, Homo sapiens
  misc_feature: GZ8MTXP02FHJXF.10.79.H02.1.454.CMB.2.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (418)..(418): a, c, t, g, unknown or other
  misc_feature (418)..(418): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttgggtcaagcctgggacgggtccctggacgactctcctgtgcagcctntggacttcgcctctggattgacgttcagtgactactacatcgaccgtgggtccnccgaggcctccgaggggaaggggctgggaggttgggtttccagtacatttactccgttagttggtgactaccattactactacgcagactntggtaggaaggcctaatccacctaatcctccgaacggacaaaccgccaaagacctcacttagactttcgactaaactcgaaccaccgtgcgaacgccggacggacaccgggtaccgttaatacgttacgtgtacgaacggtaaactaaccggttacccgttcgtaccgttcggtttaactttaccgg

SEQ ID NO: 318031 - DNA, 621 bp, Homo sapiens
  misc_feature: GZ8MTXP02JBKTO.10.79.H02.1.454.CMB.2.raw
  modified_base (272)..(272): a, c, t, g, unknown or other
  misc_feature (272)..(272): n is a, c, g, or t
  modified_base (326)..(326): a, c, t, g, unknown or other
  misc_feature (326)..(326): n is a, c, g, or t
  modified_base (385)..(385): a, c, t, g, unknown or other
  misc_feature (385)..(385): n is a, c, g, or t
  modified_base (522)..(522): a, c, t, g, unknown or other
  misc_feature (522)..(522): n is a, c, g, or t
  modified_base (566)..(566): a, c, t, g, unknown or other
  misc_feature (566)..(566): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtgggacgggtccctgacgactctcctgtgcagcctntggatcgcctcgtggattgacgttcagtgactactacatcgaccgtcgggtccnccgaggcctaccggaggggacgggctaggggaggttgggtttaccattacgtatttacnccgttaggtgtgactaaccattactactacgcagtacctgtggtagaacgggcctattaccaccctatcccgtaccgaggaaccaaaccggaccaaagtaccctcacgtagtaacctttgaacctaaatacgaaacnccctagcgacgaccggaacgacgaccggtcgttaatacgttacnggtacgaacgtaacgtaaccgttacccgtcgtaccgtttacggtttactttaccg

SEQ ID NO: 318032 - DNA, 593 bp, Homo sapiens
  misc_feature: GZ8MTXP02JM31J.10.79.H02.1.454.CMB.2.raw
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
  modified_base (505)..(505): a, c, t, g, unknown or other
  misc_feature (505)..(505): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagccgtgggacgggtccctgacgactctcctgtgcagcctctggattcgcctntggattgacgttcagtgactactacatcgaccgtgggtccncgaggcctaccgaggggacggggctggggagttgggtttaccagttacgtatttatccgtagtggtgattaccagttactactacgcagtacctgtggtaggaagggtcctaattcaaccctagtcctaccgagggaccaaacggccctaaagactcgactgtacttgacaaatgaaaccncccgtgcgaacgcccggagaccgtacggccttaatacgtcgtgtcgaacgaagtaacttacccggtcgacctttaggtttacttaccg

SEQ ID NO: 318033 - DNA, 621 bp, Homo sapiens
  misc_feature: GZ8MTXP02HR7YP.10.79.H02.1.454.CMB.2.raw
  modified_base (333)..(333): a, c, t, g, unknown or other
  misc_feature (333)..(333): n is a, c, g, or t
  modified_base (551)..(551): a, c, t, g, unknown or other
  misc_feature (551)..(551): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagcgtgggtggagtcgtgggggagcgtttggtcaagccgtgggacgggtccctgacgactctcctgtgcagcctcgtggacttccgcctcgtggattcgacgttcagtgtactactacatcgaccgtcggtccnccgtaggctccggaaggggagggtcgtgggaggttggttcccaagtacttatttactctaggtgtgactaccattacgtactacgctagactacgtggtacgaacggggcccttagttaccaccgtatcccgtaccgaggggtaaccaacggccaaagtaacctacgcttaagtacctttagaactaatacgaacctaccgcgacgcgacgacggacnccggtacttatacgtcgtggacgtaacgaacgtaacttacccggtcgtcccgttaggtttaaacttaccg

SEQ ID NO: 318034 - DNA, 584 bp, Homo sapiens
  misc_feature: GZ8MTXP02FHCGC.10.79.H02.1.454.CMB.2.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
  modified_base (485)..(485): a, c, t, g, unknown or other
  misc_feature (485)..(485): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctcnggattgacgttcagtgactacanatgacctgggtccnccaggctccgaggggagggctggagttgggttcccatacatttatcctaggtggtgactaccatactactacgcagactcgtgtgaacggccgtattcaccatcctccgagggtaccaaacggcccaaagaacctccaactggactttagactaaaatcgaaaacccnccgagaccgacggaccggacggaccaccggacgtaactaacttacgnggtacgaacgaacgtaaccgttaacccgtcgtaccgttacgttacttaaccg

SEQ ID NO: 318035 - DNA, 722 bp, Homo sapiens
  misc_feature: GZ8MTXP02HZM7D.10.79.H02.1.454.CMB.2.raw
  modified_base (326)..(326): a, c, t, g, unknown or other
  misc_feature (326)..(326): n is a, c, g, or t
  modified_base (694)..(694): a, c, t, g, unknown or other
  misc_feature (694)..(694): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagtcttggtcaagcctggagggtccctgagactctcctgtgcagccctgtggacttccgcctcgtggattgacgttcagtcgactactacagtcgaccgtgggtcccncgaggcctaccggaggggaagggctggggacgtttgggtttaccagttaccgtatttacgtccttagggtggtcgtaactaccgtaattactaaccgtacgactacgtaccttcgtaggttacgggaaccgggtccattttacccgaacccgtatttcccgaacccgaacggggtaacccaaaccggaacccaaaaggtaaccctttacgaaacccttggttaaacccttttagaacctaaaaacgttccgaaaacccttcccccgtaaggaccgaaccggtcccggaaacgggtaccaccccggggtacttaaatttaccgtaacgttcggtcggaaccgttaaaacgaaactttacccccgggttntaccccgtttaggtttaaaccttcccgg

SEQ ID NO: 318036 - DNA, 604 bp, Homo sapiens
  misc_feature: GZ8MTXP02FP3OF.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcttggtcaagcctgggagggtccctgagactctcctgtgcagcctctggattcgcctctggattgacgttcagtgactactacatcgacctggtccgccgaggctccgaggggaagggcctgggagtgggttcatactatttatcctagtgtgactacatatactacgacagactctaggtgaagggccgtagttcacctatccgtaccgaaggggaccaaacgacccaaaggaactcacttacgaatttcgaacgtaaactacgaaaaccctaccccgtagaccgaacgaccggagaccggaaccggtcccgtaaattactaacgtgtacggaacgtaacgtaaactaacccggttcgtacttacggttactttaaccg

SEQ ID NO: 318037 - DNA, 616 bp, Homo sapiens
  misc_feature: GZ8MTXP02H5Z5K.10.79.H02.1.454.CMB.2.raw
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaaaggggagctctgggagaagagcccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggagcttggtcaaggccgtgggacgggtccctgagacctctcctgtgcagcctnggatcgctctgntgacttcagtnactactanatcgaccgtggtccncgaggctcggaggggaggctgggagttggttaccagtactattacgtctaggttgtgtactacatactacctcgcagacctgaggtacggaaacgggccctagttaccacccgtatccctacgacggaaccaaacgaccaaagtacctacacgtagttaaccttacgaacaaagtccgaaacctacccgngacgaccggaaccgacggaacccgacggtaccgttaattacttcgtaggcgtaacggaacgtaaaaccgttacccggttacgacgtttacggtttaactttacccgg

SEQ ID NO: 318038 - DNA, 764 bp, Homo sapiens
  misc_feature: GZ8MTXP02JOEFT.10.79.H02.1.454.CMB.2.raw
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggagcttggtcaagccgtgggacggtccctgagactctcctgtncngcctntggattcgctntgtatgacttcagtcgactacacatgaccgtcggccnccgaggcgtaccggaggggagggcgtaggggngttgggttccagttactatttactccgtaggttggtgtactactattaacgtacctacgactacgtaactcgttaggtaacgggacgggacccgttaattacccgaaccctagttaccccgtacccggaacggggaaaccccaaaacccggtacccgtaaaacggtaaacccttacgaaccgtttaaggtaacccttttaaggaaacccttaaaagttaccggaaaacccctaccccggttacgggaaccgaaaccgggaccccgggttaaaacgggacccggtaacccgggggtacctttaaaacgttaacccgtttacggtacggtttacgggaacggtaaacccggttaaacgttaaaccccccggtttcgggtaaccccttttaacggggtttacccttttaaaccccggg

SEQ ID NO: 318039 - DNA, 650 bp, Homo sapiens
  misc_feature: GZ8MTXP02H6BHO.10.79.H02.1.454.CMB.2.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (325)..(325): a, c, t, g, unknown or other
  misc_feature (325)..(325): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcacacgaagggaaaggggagctctgggagaagagcccccagccccagaattcccaggagtttccattcggtgatcagcactgaacacagaggactcaccatggagtttgggctgagctgggttttccttgttgctattataaaggtgtccagtgtcaggtnagctggtggagtcgtgggggagcttggtcaaggcctgggagggtccctgagactctcctgngcagcctcgtggattcgcctcgtggtattggacgttcagtgactactacatcgaccgtgggtccnccgaggctccgaggggagggctgggaggttgggtttccagttactattttacncgttaggtggtntataaccagttactacacgcagtactctggtacgaacgggtccgattcacctatccgtaccgagggaaccaacgacccaaagaactcactacgtacgtttagaactaaagtcgaaacctacccctaggaccgaacggtacccggaaaagggacccgtaaacgggtacccgttaaagttaccgttaaccgtggttacggaaccgtaaacgtaaaccgtttaaccccggttacgtacccggtttaggttttaacctttaccg

SEQ ID NO: 318040 - DNA, 573 bp, Homo sapiens
  misc_feature: GZ8MTXP02J1IP7.10.79.H02.1.454.CMB.2.raw
  modified_base (271)..(271): a, c, t, g, unknown or other
  misc_feature (271)..(271): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagctggtcaagcctgggacgggtccctggacgactctcctgtgcacgcctnggattccgcctctggattgacgttcagtgactactacatcgacctgggtccncaggctccgagggagggctggngtgggttcatactntttancgtagtgtgactacatatactacgnagactcgtgtggaagggccattcaccatctccagggaccaacgcaaagtactacacgtntaccgtttagaactaaagtacgactaccgtacgacgacgaccggacggaccgacggaccgtacgtacgtacgtacgtacgtaacgaacgtaacgtaccgttaccgtaccgttacgttacgttacg

SEQ ID NO: 318041 - DNA, 645 bp, Homo sapiens
  misc_feature: GZ8MTXP02HAW36.10.79.H02.1.454.CMB.2.raw
  modified_base (347)..(347): a, c, t, g, unknown or other
  misc_feature (347)..(347): n is a, c, g, or t
  modified_base (547)..(547): a, c, t, g, unknown or other
  misc_feature (547)..(547): n is a, c, g, or t
  modified_base (597)..(597): a, c, t, g, unknown or other
  misc_feature (597)..(597): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcgaggtgaagcgtggtggagtcggtgggggagtcgttggtcaagccgtgggacggtccctgacgtctctcctgtgcacgcctcgtggtacttccgccttcgtggtacttgaccgtttcagtacgtactactacagtcgacccgtcgggtccnccgaggcctaccggaggggagggctggggtaggttggttaccagttactagtttacgtccgttaggtggtcgaacttaaccgattactacgtacgctagtaccttcgtggtacgaacggggcctagttcccaacctatcccgtaccgacgggaccaaccgacaaacgactcgactagtacttgaactaacgtacgaaccnccgtaggacgacggtaccggacggaccaccgggtaccgttatacttacgngtacgaacgtaataaccgtacccgttcgacgtttacggttacttaccg

SEQ ID NO: 318042 - DNA, 599 bp, Homo sapiens
  misc_feature: GZ8MTXP02H3Y4P.10.79.H02.1.454.CMB.2.raw
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttggtcaagccgtgggagggtccctgagactctcctgtgcagcctctggtatccgctcgtggactgacgttcagtgactactacntcgacccgtgggcccncgaggcctccggaggggaacggggcgtggaggttgggtttacccattacctatttactcctaggttgtgataccattatacctacgactaacgtactcgtggtaggaacgggcccagttaccaccctatccgtaccgaggaacaacgaccaaanaacctnactgtaccttgaacaaagtcgaaccaccctgaccgacgccggaacggaccacggacctaattacgtacgtgcgaagtaacgaacgttacccgttcgacctttaggttacttaccg

SEQ ID NO: 318043 - DNA, 601 bp, Homo sapiens
  misc_feature: GZ8MTXP02FWXSR.10.79.H02.1.454.CMB.2.raw
  modified_base (321)..(321): a, c, t, g, unknown or other
  misc_feature (321)..(321): n is a, c, g, or t
  modified_base (540)..(540): a, c, t, g, unknown or other
  misc_feature (540)..(540): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggacggtccctgagactctcctgtgcagcctctggattcgctctggattgacgttcagtgactactacatcgaccgtgggtcccncgaggcctaccggaggggaagggctgggagttggttccatactatttactctagtgtgactacatactactacgcagactctagtgaacgggctattccactatcctacgaacgggacaaaccgacaaagaacctcgactaggtaactttcgactaaaacgtcgaaaccacccgtagaccgaacgccggaaggacaccgggtaccttaatacttaccgngtacgaacgtaaacgtaaccgttaaccccggtcgtacccgttaggtttaactttaacccgg

SEQ ID NO: 318044 - DNA, 626 bp, Homo sapiens
  misc_feature: GZ8MTXP02JOTRU.10.79.H02.1.454.CMB.2.raw
  modified_base (292)..(292): a, c, t, g, unknown or other
  misc_feature (292)..(292): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
  modified_base (524)..(524): a, c, t, g, unknown or other
  misc_feature (524)..(524): n is a, c, g, or t
  modified_base (570)..(570): a, c, t, g, unknown or other
  misc_feature (570)..(570): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggtcgttggtcaagccgtgggacggtccctgagactctcctgtcgcacgtcctcgtgtacttccgccttcgnggtattggacgttcagtcgaactactactagtcgaccgtcgggtcccgccgacggctcccggaggggacggggctgggaggttggtttccatacctatttatcgtaggtggtcaacttaccattactacgtacgnacggtactgtagtggacggcgtactccacgntccaccgaaggaccaaacgccaaagaactcctacgtgtaaccttgaactaaacgtcgaaacctcgngacgaccggtaccgaggtaccaccggttcgtaatttacgtacggtnacggtaaccgaaacgtaaacccgttacccggtctccgtttaaggttacctttaacg

SEQ ID NO: 318045 - DNA, 574 bp, Homo sapiens
  misc_feature: GZ8MTXP02IY7XP.10.79.H02.1.454.CMB.2.raw
  modified_base (275)..(275): a, c, t, g, unknown or other
  misc_feature (275)..(275): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggaggtcttggtcaagccgtgggacggtccctggacgtactctcctgtgcagcctntggattcgctctgattgacgttcagtgactactacatcgaccgtcgggccnccgaggccgtccgaaggggaggggtctgggaggttggttaccagtactatttactcgtaggttgtgtatacatanactcgcatctcgtgtagacgggcattacgactntcctacgagaccaacgaccaaacgactacnctgtactganaactacacnccgtnacgacgtccgagacctacggtacgtatacgttacgtcgtagaaccgaacgtaaccttacccggtgtaccgttaggtttaccttacg

SEQ ID NO: 318046 - DNA, 699 bp, Homo sapiens
  misc_feature: GZ8MTXP02HM8FX.10.79.H02.1.454.CMB.2.raw
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (661)..(661): a, c, t, g, unknown or other
  misc_feature (661)..(661): n is a, c, g, or t
  modified_base (683)..(683): a, c, t, g, unknown or other
  misc_feature (683)..(683): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcggtgggggagtcgttgggtacaacggccgtggggaccgggttcccctaggacgtaccttcttcccgtggtcgccgacgtccttcgtacggtacttccgccttcgtggtaacttcgtacgttctagtacgactactacacgtcgaccgtcggtcccgacgacggccgtaccggaaggggacgggtcgtagggtaggtcggtaccgttacgtaagtttagttaacgaaacgaggtacgtcggtacctaaacgttaaactaagtttatttaccgttacgttaccgtaaccgttcccggtaacggggtaacccggggttccccgttaccctacccccgtgttacccgaaacgacgtaaccctaccgttaaccaaactactactttcgttatactcctanactancgctaacatcgtagacgtacgacgaccgtacgaccgtactaacgttnttacgtgaacgtcgaactactntaccgacttaccgtac

SEQ ID NO: 318047 - DNA, 582 bp, Homo sapiens
  misc_feature: GZ8MTXP02JX3E0.10.79.H02.1.454.CMB.2.raw
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggtcgttggtcaagcctgggagggtcccctgagactctcctgtgcagcctctggattcgccttcgtggattgacgtttcagtgactactacatcgaccgtgggtcccgccaggctccgaggggaaggggtctgggaggttggggtttccccagttacattttactccgttaggtggtgaactaccaattactactacgcagactcgtgngaacgggccgattccaccatcnccgagggaccacgaccaagaaccncactagactttgactaatacgaacacccgtgacgacgccgaggacacggccgtatactacgtgtagaacgagaacctacccgtcgtaccttacggttactttaccg

SEQ ID NO: 318048 - DNA, 626 bp, Homo sapiens
  misc_feature: GZ8MTXP02JF0HP.10.79.H02.1.454.CMB.2.raw
  modified_base (182)..(182): a, c, t, g, unknown or other
  misc_feature (182)..(182): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
  modified_base (529)..(529): a, c, t, g, unknown or other
  misc_feature (529)..(529): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgtgctattataaaggtntccagtgtcaggtgaagctggtgagtcgtgggggagcttggtcaagcctgggaggtccctgagctctctgngcagcctntggatcgcctntggatgacgttcgagtagactactacatcgaccgtgggtcccncgacggcctacggaggggaacgggctggggagtttcggttaccattacgtattttactccgtaggtcgtgacttaccaagttactaaccgtacgcaacggtacttcggtgtaacgggacgggtccctaattccaacctatcccgtaccgaagggaaccaaccggaccaaacggaaccttccgaacttgtaaccttagaactaaacgcgaaaccnccgtacgacgacgccggaacgacgacccggtataattacgtacgtggacgtaacgaacttaaccgttacccgtcgtaccgttacgttactaacccgg

SEQ ID NO: 318049 - DNA, 738 bp, Homo sapiens
  misc_feature: GZ8MTXP02FWSW4.10.79.H02.1.454.CMB.2.raw
  modified_base (340)..(340): a, c, t, g, unknown or other
  misc_feature (340)..(340): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgctattaataaaaggtgtccagtgtcaggtgaagctggtggagtcgtgggggagtcttggtcaagccgtgggacgggttccctagacgacttctcctgtcgcagcctcgtggacttcgcctgtggattgacgttcagtcgactacgtacatcgtaccgtggggtccccnccgaggcccgtccggaagggggaggggtctggggtaggtttcgggtttaccattacgtattttactcgttaggtggtgactaccgtaattacttaccgacgcacgtactcgtaggtcggaaacgggtcctattaccaccgtactccgtaccgaacggggaccaaaccggtaccaaaacggtaccttacaccgtttacgactttacgacgtaaactaccggaaaccctacccgaggaccggaaccggaccgggtaaaacggggacccgtaacccggggtaacccggttaatttaacgttttaaacccggtacgggttacggtaaaccggttaaaccgttaaacccggtttaacccccggttaccggtttacccggtttacggtttaaacccgtttaccg

SEQ ID NO: 318050 - DNA, 618 bp, Homo sapiens
  misc_feature: GZ8MTXP02F2DPI.10.79.H02.1.454.CMB.2.raw
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (488)..(488): a, c, t, g, unknown or other
  misc_feature (488)..(488): n is a, c, g, or t
  modified_base (566)..(566): a, c, t, g, unknown or other
  misc_feature (566)..(566): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaagccgtgggagggtccctgagactctctgtgcagcctctggattccgcctcgtggtattgacgttcagtgactactanatcgacctgggtcccncgacggcctccgaggggaacgggctgggtaggtgggtttaccagtactatttactccgtagttcgggtgactaacctatactaacgtacgcagtactcgtacggtagaacgggacccgtattaccaccatcctaccgaaggacaaaccgaccaaagaccctanacctagtaccttagacctaaatacgaacctaccgtgacgtaacgcggaacggtagaccggtaccgtatacgtttacgngtacggcgtaacgaacgttacccgttcgaccgttacggttactttaacccgg

SEQ ID NO: 318051 - DNA, 603 bp, Homo sapiens
  misc_feature: GZ8MTXP02JGYUG.10.79.H02.1.454.CMB.2.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (429)..(429): a, c, t, g, unknown or other
  misc_feature (429)..(429): n is a, c, g, or t
  modified_base (522)..(522): a, c, t, g, unknown or other
  misc_feature (522)..(522): n is a, c, g, or t
  modified_base (555)..(555): a, c, t, g, unknown or other
  misc_feature (555)..(555): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggagggtccctggagactctcctgtgcagcctgtggattccgcctctggattggacgttnagtgactacacatcgacctgggcccnccaggcctccggaggggaacggggctagggtaggttcgggtttcccaagttaccgtattttactccgtaggtggtgtatacccgattactaactacgactagacctntggtaggaacggggccctagttcccaccatccgtccgaggggcctacggacccaaagaaccttcactgtacttgacaaatcgaacctacccgngacgacgaccgagacgacggtctattactacgngtacgaacgtaacgtaaccgtacccgtcgtaccgttacgttacttacg

SEQ ID NO: 318052 - DNA, 766 bp, Homo sapiens
  misc_feature: GZ8MTXP02HZD31.10.79.H02.1.454.CMB.2.raw
  modified_base (183)..(183): a, c, t, g, unknown or other
  misc_feature (183)..(183): n is a, c, g, or t
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (405)..(405): a, c, t, g, unknown or other
  misc_feature (405)..(405): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtntccagtgtcaggtgaagcttgggtggagtcgtgggggagcttgggtcaagtccgtggacgggtccctgacgactctcctgtgccagcctgtggtacttccggcttcgtggtagtcgtaccgttcagtcgtaatactaacntcggacccgtggggtcccnccgtaggcccttacggaaggggtaacggggctaggggaggtttgggtttacccaagttacgtntttttacgccgttaggttggtacgtaacttaaccctattaacgtacccgttacacgtacgtacttcgtaggttaacgggacggtaccgttacttacgacccttagtccctaccgggacgggaacctaaaccggtacctaaaacggtaacccttccgtaaccgttagggtaacccctttaagggacctaaaaggttcccggaaacctaacccggtcgaaccgaacgggtaccccggaacggggtaaaccacgggttaacccggtttataacggttacccgttagggaccgtaaccgtaaaaacggttaaacccgttacccccggttttacggaccgtttttacgggtttaaaactttcccgg

SEQ ID NO: 318053 - DNA, 868 bp, Homo sapiens
  misc_feature: GZ8MTXP02G151F.10.79.H02.1.454.CMB.2.raw
  modified_base (187)..(187): a, c, t, g, unknown or other
  misc_feature (187)..(187): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtntccagtgtcaggtgaagctggtggagtcgtgggggagtcgttggcaacgccgtgggacgggtccctgacgacctctccgtgtcgcacgcctcgtggtattccgcctcgtggtacttcggacgttgagtcgaaccttactacgtacgtcggaacccgttggggtacccccgcgtaacgggtcccgtacccggggaaggggggtaacggggtcgtagggggtaaccggtttggggtttacccctaattaaccgtttaagttttaccgtccgtttaaggggttgggtacgtaaacgttaaaccctaggtttaaccaccgttaaccggctaacgtaacccttcggttagggtaacgggtaaacgggggcccttaaacgttaccccgaacccgtacgttaccccgtaaccgggaaaacggggaaaccccaaaaccggtaccccgtaaaaacggtaaccccttaccgaactttaaaccgggttaaccttttaacgaaaacccgttaaaagtacccggtaaaaacccgtcccccgtagggaacccggggaaccgggggttaccccgggggaacccggtaccgggggttaaccttaaacgttaactttaccggtagtacggaaccgtaaacggtaaaacccgtaacccggtttcggtaccgtttaacgggtttactttaccggtaaccg

SEQ ID NO: 318054 - DNA, 582 bp, Homo sapiens
  misc_feature: GZ8MTXP02FM9DV.10.79.H02.1.454.CMB.2.raw
  modified_base (270)..(270): a, c, t, g, unknown or other
  misc_feature (270)..(270): n is a, c, g, or t
  modified_base (318)..(318): a, c, t, g, unknown or other
  misc_feature (318)..(318): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
  modified_base (540)..(540): a, c, t, g, unknown or other
  misc_feature (540)..(540): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggagcttgggtcaagcctgggagggtccctgagactctctgtgcagcctctggnttcgctcgtggattgacgttcagtgactactacatcgacctgggtccnccgaggcctccgagggggaacgggctagggagttgggtttccagttacgatttactccgtaggtcgtgactaccgattactactacgctaagactgtagtacgaaagggcccaattccacctatccgtaccgagggaccaacggccaaagacctcatgtactttcgacaaaagtcgaaacctccgngacgacgtaccgaggacncggaccttaatactacgngtagcgaaataacgttacccgtcgtactacggtttactaccg

SEQ ID NO: 318055 - DNA, 559 bp, Homo sapiens
  misc_feature: GZ8MTXP02GQB9Q.10.79.H02.1.454.CMB.2.raw
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (473)..(473): a, c, t, g, unknown or other
  misc_feature (473)..(473): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagcgtggtggagtcgtgggggagcttggtcaagccgtgggacgggtccctgagactctccgtgtcgcagtcctcgtggacttcgcctgtggtattgacgttcagtcgactacacagtcgaccgtggccncgaggcctcggaggggaggctaggngtggttccatactattacncgtagtgtnactacatactacancanactgtgagacggctatcactntcgacgagacacgacaaagactcactgtacttgactaaatcgaaacctccgngacgacgacgaacgacacggtactatacgtacgtgtacgaacgtaaagtaaccgttaccggttcacgtttacggttaacttaccgg

SEQ ID NO: 318056 - DNA, 686 bp, Homo sapiens
  misc_feature: GZ8MTXP02FUL2N.10.79.H02.1.454.CMB.2.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcttgggttttccttgttgctattaataaaaggtgtccagtgtcaggtgaagcgtggtggagtcgtgggggagtcgttggtcaaggccgtgggacgggttccctgacgaccttctcctgtcgcacgtccttcgtggtattccgcccttgtaggtattcgtacgttcgagtcgtacctactacagttcggtaccgtcggggtacccgccgacggccctaccggagggggaacgggcgtggggtaggttcgggtttaccaagttactaagttttactacgttaggttgggtgtaactaacctaattacctaacgtacgactagtaccctgtaggacggaacgggcctattccacgtattcccgacgacggaacaaccgacctaaagacctacgacgttagtacttagactaaaatcgaaaaccttccgagcgaacgaccggtaggaaaccgtaccgggtaccttaaattacgtaacggtgtacgaacgtaaacgaacgttacccccgtgttaacccgttggttacctttaaccgg

SEQ ID NO: 318057 - DNA, 666 bp, Homo sapiens
  misc_feature: GZ8MTXP02IMY4W.10.79.H02.1.454.CMB.2.raw
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagccgtgggacgggtccctggacgactctcctgtgcagcctcgtggactcgcctgnggtattcgacgttcagtgaactactacatcggacctgggtcccnccgaggtcctacggaaggggaggggtctaggggagttcggggtttaccaattactattttaacncgttaaggttggtanacttaaaccaattactaactacgactanacctntggtagaacgggctaattcacctaatcaccgaggacaaacgcaaaanaacgtnaacgtgtaactttgaacaaaatacgaaacctacccgagaccggaacgacccgggtaacgaccggtaccggtaccgttaaacgttaattaaaccgtggtaacgaacccgtaaaaggtaaaccctttaaaaccccgttccggtaacccgtttaggtttaaaacctttaaccgg

SEQ ID NO: 318058 - DNA, 832 bp, Homo sapiens
  misc_feature: GZ8MTXP02H44K7.10.79.H02.1.454.CMB.2.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagcgtggtggagtcgtgggggagtnttggtcaagccgtgggacgggtccctgagtacctctccngtgcagcctntggattcgctctggatgacgttcagtcgactacgtacagtcgaaccgttggggcccncccgagggccctaccggaagggggaacggggcttaggggaggtttcggggtttacccaagttacctatttttaacgtcccgttaagggttcgggtgtaaacttaacccgtaagtaattaaccccggttaacgcctaaacgtacccgttcgtacgggttacggaacgggggtaccccgtaaagttttacccgaaaccccgtacgttaacccggttaaccccgaacgggggaaaaccctaaacccgggtaaaccccgaaaaaccggtaaacccctttaccgtaaacccgtttacgggttaacctttttaaccggaaccctaaaaagttaccgaaaaccgtaaacccccggtacggaacccggtaaaccggaccccgggaaacgggtaaacccggaacccgggttacccgtaaagttaccgtttaacgtacggtacggtaacggtaaacgtaaaaccgttaccccggttaccgtacccgtttacgggtttaaacctttacccg

SEQ ID NO: 318059 - DNA, 683 bp, Homo sapiens
  misc_feature: GZ8MTXP02J0URP.10.79.H02.1.454.CMB.2.raw
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagcgtgggtggagtcggtggggggaggtcgttggtcaacggccgtggggacggggtcccctggacgactctcctgtcgcagcctgtggnttccgcctcgtggtattgacgttcagtcactacacatcgccgtcggtccncgcggctcggaggggagggcgtggaggttggttccattactatttacncgtaggttgngactacatactacacgcagactcgtaggtaggaacgggtcctacgttcacctactcccgtaccggaacgggtaaccaaaaccggacccaaaacgtaacccgtacctaaccgttacgttaactttacgaaactaaacgtacccggtaaaaccctcccggtacggaccggaacggacccgggtacggaaccggaccgggttacgttaacgtttacgttacgtcggtaacggtaaccgtaaacgtaaccgttacccggttcgtaccgtttacggtttacctttaccgg

SEQ ID NO: 318060 - DNA, 683 bp, Homo sapiens
  misc_feature: GZ8MTXP02FPBMC.10.79.H02.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (462)..(462): a, c, t, g, unknown or other
  misc_feature (462)..(462): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtcagtgtcaggtgaagcgtggnggagtgtgggggaggcttggtcaagcctggagggtccctgagactctcctgtgcagctcgnggtattccgcctntggattgtacgttcagtagactaactcatcgaccgtcgggtccaccgagcctaccgaggggaaaggggctgggagttgggtttacagtactagtttactcgttagtgggtanactactattaactactacggntaaacgtacctacgtggttacggaacggtacggtaacgttaccgaaaccccncttaccgtaacccgacggaacctaaaccggaaccaaacgaaccgtacctacgttacgttaaccgtttacgaactaaacgtaacgtaaccgtaaccgtacgtacggacggaccggtaacgggaccggaaccggtaaccgttaacgttacgttacgttacgttacggtaacggtaacgtaaaccgttaacccgttaccgtaccgttacggtttacgtttaccg

SEQ ID NO: 318061 - DNA, 645 bp, Homo sapiens
  misc_feature: GZ8MTXP02IQS4R.10.79.H02.1.454.CMB.2.raw
  modified_base (281)..(281): a, c, t, g, unknown or other
  misc_feature (281)..(281): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtaggctataataaaggtgtccagtgtcaggtgaagcgtggtggagtctgggggagcttggtcaagccgtggagggtccctgagactctccgtgtcgcagcctgtggattcgccttntgtattcgacgttcagtcgtactacacgtagtcgtaccgtcggtccgcgacggtccgtacggaaggggtacgggtcgtagggtacggttggttaccaagttacttagtttacgtccgttaggttcgtcgtacctaactacgtactaccgtacgctaacgtacgttgtaggtacggacggtacgtacgtactacctactaccgtacgacgacgaacgaaccgaacgaactacgtacgtacgtacttacgtactaactacgaacgtaccgtacgacgacgacggacgacgacggtacgtacgtacgttacgtacgtacgtaacgtaacgtaaccgttaccgttacgtaccgttacgttacgttacg

SEQ ID NO: 318062 - DNA, 648 bp, Homo sapiens
  misc_feature: GZ8MTXP02JW1KJ.10.79.H02.1.454.CMB.2.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccagctctcctgccagggccagtcagagtctagcagcaactacgttgccttggtaccaacagaaacctggccaggcctcccgggctacctcatctatggtacntctagcagggccacgtggcatcccagacaggttcagtcggcaggtgggtacctggggacaggtaccttcgactcctacaccgatcacgcagacgtggagtcgtagtaagtactttggacgtaggttagttaagtttagttggtaccgtaggtactaagttacggttaggttaacggttccgtaaccggtttacgggggttacgtttttacggggacccgtaacgggggtaaccctaaaagggtcgttagggacgtaaacgtaaccgtaaaaccggtaaccgttacggtacggtaaccgttaccggacctacccggtaacttacccgtttcggttacctttcccgg

SEQ ID NO: 318063 - DNA, 764 bp, Homo sapiens
  misc_feature: GZ8MTXP02F7NLH.10.79.H02.1.454.CMB.2.raw
  modified_base (187)..(187): a, c, t, g, unknown or other
  misc_feature (187)..(187): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtntccagtgtcaggtgaagctggtggagtcgtgggggagcttggtcaagccgtgggagggtccctgagactctcctgtcgcacgcctntggacttcgcctntggtattgacgttcagtgaactactacagtcgaccgtcgggtcccgccgacggcccgtaccggaagggggtaacggggcgttaggggtacggtttcggggtttaccctaagtttaaccgtagtttttaacgtcccggttaagggttcgggtacggtaaacttaaacccgtaaagtttaaaccgttaaccgtaaccggtaccgtaacgggttaaacccttccggtttagggtaacgggtaaaacgggggtccccgttaaatttacccccgaaaccgttaacgttcccgtaacccgggaaacgggggaaacccaaacccggtacccaaaacggtaaaccctaccgaacgttacgtaactttacggaaactaaagtacgaaaccccaccgtagacgacgccggaaggacctacggtactattacgtacgtgtacgaacgtaacgtaaccttaccggtctaccgtttacggttactttaccg

SEQ ID NO: 318064 - DNA, 770 bp, Homo sapiens
  misc_feature: GZ8MTXP02IPTFH.10.79.H02.1.454.CMB.2.raw
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggagtcttggtcaagtccgtgggacgggtccctgacncctctcctgtgcagcctcgtggacttccgccttntggtattgacgttcagtgactactactagtcgtacccggtcggggtccccgaccgtacgggtcccgttacccgggaaggggggtaacgggggccgttggggtaacggggttttcggggttttaccaaacgtttaaccgttactttttaacgttcccgtttaaggggttcggttcgtaactttaaacccatttaaaccgttaacccttacggactaacggtaccttcgtaggtacggaacgggtcctaagttacccacgtacttccgtaccgaaagggaacccaaacggaccctaaaaggaaccctcgtacgtacggttaactttagaacctaaaagttaccggaaaacctccgcgggaacgaaccgggtaccggacgggaaccgtacccggtaacgttaactttagttaccgtaggtacgaaccgaacggttaaacccgttaccggtttccgtaccgtttacgggtttaacctttaccgg

SEQ ID NO: 318065 - DNA, 645 bp, Homo sapiens
  misc_feature: GZ8MTXP02I7XMN.10.79.H02.1.454.CMB.2.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (321)..(321): a, c, t, g, unknown or other
  misc_feature (321)..(321): n is a, c, g, or t
  modified_base (490)..(490): a, c, t, g, unknown or other
  misc_feature (490)..(490): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagtcttggtcagcctgggagggtccctgagctctctgtncagcctctggtacttcgcctcnggattgacgttcagtgactactcagtcgaccgtggggtccncaggcctaccggaggggacgggtctgggtaggttggtttccaatactatttacgcttaggtgtgtactaactagtaactaccagtcagtaccgtctggtacgaacggggtcctattccgaccctagtccctaccgaagggaaccaaaccggtaccaaacgtaaaccctntaccttggtaactttacgactaaagtaccgaaacctccgtacggagaccggaccggaacggaccgttccgggaccttaagttacgttaccgttagacgaacgaacgttaaacccgttaacccggtccgtaccgtttacggtttaacctttaccgg

SEQ ID NO: 318066 - DNA, 719 bp, Homo sapiens
  misc_feature: GZ8MTXP02JT6KY.10.79.H02.1.454.CMB.2.raw
  modified_base (364)..(364): a, c, t, g, unknown or other
  misc_feature (364)..(364): n is a, c, g, or t
  modified_base (666)..(666): a, c, t, g, unknown or other
  misc_feature (666)..(666): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgcttattaataaaggtgtccagtgtcaggtgaagcgtgggtggagtcggtgggggagtcgttgggtcaaggccgttggggacgggttccctggacgtaccttcgtccgtgcgcacgcctgtggattccgcctgtggtattcggtacgttcgagtacgaacctactaactacgttcggacccgtcggggtccccnccgacggtcccgtaccggagggggtaacggggtctggggtagtttcgggtttaccaagttacgtattttacacggttaggttgggtactactaaccgtatacttacgacgactaggtacctgtggtacggaacggggtccttaacgttcccaactacgttcccaacgggaaaccggtaaccaaacccgggaccaaaacggtaacccttcgtaaccttcggttaacgtttacgaacgttaaagtaccgaaacctccgagaccgacggaccgtacggacgaccggtactattacgtcgtacggngtaaccggtaactaaccgttacccggtcgtacggtttcggtaactttacccgg

SEQ ID NO: 318067 - DNA, 512 bp, Homo sapiens
  misc_feature: GZ8MTXP02FOOFM.10.79.H02.1.454.CMB.2.raw
  modified_base (347)..(347): a, c, t, g, unknown or other
  misc_feature (347)..(347): n is a, c, g, or t
  modified_base (490)..(512): a, c, t, g, unknown or other
  misc_feature (490)..(512): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgacaaatgaacaccctgcgagccgaggacacggccgtatattactgtgcgagaactacccgttcgccttggttattaccttgactacgttgggccaggggaccctggtccaccgtctcctcacgcctccaccgaacggcccatccggtccttcccccgtggccgccctgcctccgaggacnccaccgtcccgagacgccacgaggccggcccgtggggcctcgcccgtagggtccaaacgggtacccttacccttcccaacttacgttacgtcgctacgggacgggccggggtcgtaggggaccgaaagggccgactaagtagnnnnnnnnnnnnnnnnnnnnnnn

SEQ ID NO: 318068 - DNA, 665 bp, Homo sapiens
  misc_feature: GZ8MTXP02HMXC5.10.79.H02.1.454.CMB.2.raw
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctgggtggagtcgtggggggaggcttggtcaagcctgggagggtccctgagactctcctgtgcagcctcgtggattccgcctctggtattgacgttcagtcgactactacatcgaccgtgggtccnccaggcctcgagggagggctgggagtggttccatactatttancgtagtggtgtataccaattactaacctacgctagactcgtgtagaacggggtcctattccgacctacgttcctaccgacgggaaccaaacccggacccgaaaaggtaacccttaccaacgttacggtaacctttagacctaaaagtaccgtaaccacccctaggacgacggacccggaacgggtaaccgaccggggtaccttaaactacgtttaccgtaggtacgtaacccggaaagtaaacccgtttaaccccggtttccggtacccgtttagggtttttaacctttacccgg

SEQ ID NO: 318069 - DNA, 587 bp, Homo sapiens
  misc_feature: GZ8MTXP02HVAJS.10.79.H02.1.454.CMB.2.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
  modified_base (527)..(527): a, c, t, g, unknown or other
  misc_feature (527)..(527): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagcgtggtggagtcgtgggggaggcttggtcaagccgtgggacgggtccctggacactctcctgtgcagcctctggattcgctctggtatgacgttcagtnactactantcgaccgtggtccnccgaggcctcggaggggacgggngtaggagttcggttacagtactattatctaggtgtnataacatacgtanacgnagctntgngacggctattcacctatcacgaggacaacgaccaaagactnactgtactagacaaactcgaacctccgtgaccgaacggaccggaacgaccgaaccgggtacttaacttacgttaacgngtacgtaacgtaaacgtaaaaccgttacccgtcgttaccgttacgttttaactttaaccg

SEQ ID NO: 318070 - DNA, 589 bp, Homo sapiens
  misc_feature: GZ8MTXP02G7S7W.10.79.H02.1.454.CMB.2.raw
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctcgtggacttcgcctcgtggattgaccgttanagtcgactactacatcgaccgtggccnccgaggcctcggaaggggagggtctaggaggttggttaccaatactatttactcgtagtgtanactaaccatactactacgacactactgtaggaggaacggcctattaccaccataccgaccgaacggaaccaacgtaccaaaacgacctacaacgtacgtacttagaacaactaacgaaccaccacgacgacgacgacgacgacgacgtactactacgtagtagaacgaacgtaacgtaccgtacgtacgtacgttacgtacg

SEQ ID NO: 318071 - DNA, 628 bp, Homo sapiens
  misc_feature: GZ8MTXP02HD3J6.10.79.H02.1.454.CMB.2.raw
  modified_base (280)..(280): a, c, t, g, unknown or other
  misc_feature (280)..(280): n is a, c, g, or t
  modified_base (328)..(328): a, c, t, g, unknown or other
  misc_feature (328)..(328): n is a, c, g, or t
  modified_base (520)..(520): a, c, t, g, unknown or other
  misc_feature (520)..(520): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgcttattaataaaaggtgtccagtgtcaggtgaagctggtggagtcgtgggggagtcttggtcaagccgtgggacgggtccctgagtactctcctgtgcagcctcgtggntccggctctggattgacttcagtgactactacatcgacctgggtcccncgaggcctcggaaggggacgggtcgtagggtacggttggttacccatacttatttactcgtaggtgtgactcaatatacgtacgcagtactcgtagtacgggaagggtcccattccaccctattcccgaccgaaagggaccaaaccggcctaaaagaccttcactcggtacttagaaacaacttcgaaaccncccgtaggaccgaccggaccgaacggaccacggggtaccttagtaacttcgtggacgaaccgtaaagtaacccgttaaccggtccgtaccctttaggttactttaccg

SEQ ID NO: 318072 - DNA, 547 bp, Homo sapiens
  misc_feature: GZ8MTXP02JM8ZX.10.79.H02.1.454.CMB.2.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtctgggggagcttggtcaagcctggagggtccctgagactctcctgtgcagcctctggatcgctcnggattgacttcagtgactactanatnacctggccncagctcgagggacggntggagtgtaccatactattacncgtagtgtnatacatactacgtacganagacttagtagtaggacggtctactacaccagcacgacgacgaacgacaacgaacactactacgtactacgacaactacgacacctacgacgacgacgacgaacgacgtacgtactacgtacgtacgtacgaacgaacgaacgtaaccgtaccgtaccgtacgttacgtacg

SEQ ID NO: 318073 - DNA, 737 bp, Homo sapiens
  misc_feature: GZ8MTXP02JCT2X.10.79.H02.1.454.CMB.2.raw
  modified_base (268)..(268): a, c, t, g, unknown or other
  misc_feature (268)..(268): n is a, c, g, or t
  modified_base (335)..(335): a, c, t, g, unknown or other
  misc_feature (335)..(335): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagctggtggagtcgtgggggagcgttggtcaaggccgtgggagggtccctgacgactctcctgtcncacgcctcgtggattcgcctcgtggattggacgttcagtcgactacacatcgaccgtggccccgcgnggccgtccggaaggggaacggggcgttagggaggtttggggttacccaattacgtacgttttactccgttaggtgtacgtaacttaaaccctaatttacgtaaccgttacggaccgtaaacgtaccgttcgttaggtacgggaaacggggtcccgttaatttacccgaaccccttactcccgtacccgggaacgggaacccaaaccggaacccaaaacgtaaccgttcaacgttacggttaactttacgaactaaaacgtacgaaaacccttccgtggaccgaaacggcccgggaaggtaaccccgcggggtaaaccttaacgtacgttaacgtcgtacggaacggttaaacgtaaaaccggtttaccccgtaccgttacggttacgtttactttaacccgg

SEQ ID NO: 318074 - DNA, 569 bp, Homo sapiens
  misc_feature: GZ8MTXP01BLUD3.44.35.D02.1.454.CMB.2.raw
  modified_base (363)..(363): a, c, t, g, unknown or other
  misc_feature (363)..(363): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaaacttgagtgataattgcttcctgtatcagcagaggccaggccagcccctatgctggtcatctttcaggataataagccggccctgagggactcccgtgacgcgtcttcctctggcctccaactcgtagggaaccnccgccactctcgaccatcacgcgaccgaccacgcctcgaggactgacgctagtaacttattacgtggtacgtaggtacggtagggaagtgtacgttaggttgggtcgtcgggacggacggaccgaagtcgttacggtaccgttcgtcggtacacgcccgacggtcccgtccgtccccgtacggtccttccgttccgttccgtcccc

SEQ ID NO: 318075 - DNA, 539 bp, Homo sapiens
  misc_feature: GZ8MTXP01CJGVL.44.35.D02.1.454.CMB.2.raw
  modified_base (263)..(263): a, c, t, g, unknown or other
  misc_feature (263)..(263): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaattgcttcctgtatcagcagnggccaggccagccccctatgctggtcatctttcaggataataagcggccctcgagggactccctgacgcgtcttcctctggctccaactctgggaacacggccactctgaccatcagcgcgacccagcctgtcggatgacggctgactattactggtcaggcgtagggaaagtgctaagttgggtgttcgggcggagggccaaggcgttaggacccgttgtcggtcacggttcccaaggcctcggccccctcgggtcacctccgttcggttccccc

SEQ ID NO: 318076 - DNA, 552 bp, Homo sapiens
  misc_feature: GZ8MTXP01AQHMO.44.35.D02.1.454.CMB.2.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctctggtgttacatcagtagttattattggagttggctgcggcagtccgcgggaaggactggagtggattgggcgcatctataacagtggcagcacaactacaaccccgcctnaagngtcgacgtcacatgtcaactagcaggtcccaaagaccagttcctacccttaaattgacttctgtcgaccgccgacggacacggccgtatacttatgtgcggagagtattcctatcgatacagtagaggacgggggcaacgtggcttcggacccgttggggccgacgggacccgttggttccaaccgtctcctcacgccctccgaaccgaacggg

SEQ ID NO: 318077 - DNA, 558 bp, Homo sapiens
  misc_feature: GZ8MTXP01BPRC2.44.35.D02.1.454.CMB.2.raw
  modified_base (210)..(210): a, c, t, g, unknown or other
  misc_feature (210)..(210): n is a, c, g, or t
  modified_base (328)..(328): a, c, t, g, unknown or other
  misc_feature (328)..(328): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctntcctgcactggaactaatactgatgttaggaaaatataaccttgtctcttggtaccaagtatacccaggtaaacccccaaactccttctttatgaagtcaatagcgcctggcatttcncatcgcttctcaggctccaagtctggcaacacggcctcgttgataatttctgcctctgcctgacgacgagccgactattattgctgctcatatggacgggggtccttagacttagttgggtcttcgggcgggacgggtaccggccttgacccgtcgtaacgggtcaaggcccaagggcctcgcccccgttgggttccaactcgttcttccccaccttcctcttaactaac

SEQ ID NO: 318078 - DNA, 540 bp, Homo sapiens
  misc_feature: GZ8MTXP01BBHJ9.44.35.D02.1.454.CMB.2.raw
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggactggagtggattgggcgcatctataacagtggcagcaccaactacaaccccgcctcaagngtcgacgtcacatgtcaactagcagggtccaaagaccagttcnccctagaaattgacttctgtgaccgccgcggacacggccgtatattattgtggcgagagattcctatcgatacagtagaggacgggggcaacgtggctcgacccgtggggccacgggacccttggtccaccgtctcctcacgtccttccgaacccg

SEQ ID NO: 318079 - DNA, 577 bp, Homo sapiens
  misc_feature: GZ8MTXP01BTTBB.44.35.D02.1.454.CMB.2.raw
  modified_base (372)..(372): a, c, t, g, unknown or other
  misc_feature (372)..(372): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaaacttgagtgaataattgcttcctggtatcagcagaggccaggccacgccccctatcgctggtcatctttacgaggtataataagccggccctcgagggactcccgtgacgcgtcttcctctggctccaactcgtacgggaacncggccactctgaccatccacgcgccgacccacgtcctcgtacggatcggacggctagtaacttattaccgtggtacaggtaccggtagggaaagtgacgttaagttggggtacgttcgggacggacgggtccaaggtcttggtacccgttgtcggtcacggccttaggcctccgccccgtggccacgttccgttccgttaacccc

SEQ ID NO: 318080 - DNA, 675 bp, Homo sapiens
  misc_feature: GZ8MTXP01C17SA.44.35.D02.1.454.CMB.2.raw
  modified_base (263)..(263): a, c, t, g, unknown or other
  misc_feature (263)..(263): n is a, c, g, or t
tcagacagtatatacacgaccggtgctcgatttagcacacgatagttgggtttggggatactttctgagactcatgggcctcctgcacaagaacatgaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcgnagtcgcggaggctggagtggatggcgcatctataacagtgcagcaaccaactaccaacccccgcctacaacgagtacgacgtccaccagtgtaccaaactaagaacaagggtacccaaaacgaaccctagttccctaccctaggtaaactttcgtaaccttcgtagttaccgacccggccggaccggaaccgaccgggtacccgttaattaagtttaagtttcgtaggggtacggtaaggtagtacttacctataccgtataacgaggtaaagggacgggacggggggctaaacggtcgggaccgttccgggaaccccggttcgggggaccccgttaccgggggacccttcggggtaaccctacccgggttccctcccgtaccgaccggtccccttaacccgaacccccggg

SEQ ID NO: 318081 - DNA, 763 bp, Homo sapiens
  misc_feature: GZ8MTXP01B41IA.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgaataaattgcttcctggtatcagcagagccaggccacgccccctatcgactggtcacttcctttacaaggtataaagttaacggccgggtcccctacgaacgggggtactccccgtaggaacgtccggtcctttccctccgttcgggacccttaccccgtaaaccgttccggtaacgggggaacccgacccggggtcccctaaaccgttccgttacgggaaaccccagttacccgacggaccgaccccggaaccccgaaggccccttcggtaggggaacttggaacgggtcctacgggtaaccttaacgtttacccgtaggttaccgaagggtaaccgggttaagggggaaaacgttcggtaaccggtttaaaggtttcgggggttacggtttacccgggggacggggtaacgggaacccgtaaaggtccgttacggtaacccgttcggtaccggtcgacggccccgaagggtcctcccggcccccgttgggtccttaccgttccgttcccggtttaacccccg

SEQ ID NO: 318082 - DNA, 543 bp, Homo sapiens
  misc_feature: GZ8MTXP01EDFY5.44.35.D02.1.454.CMB.2.raw
  modified_base (405)..(405): a, c, t, g, unknown or other
  misc_feature (405)..(405): n is a, c, g, or t
  modified_base (478)..(478): a, c, t, g, unknown or other
  misc_feature (478)..(478): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattgggcgcatctataacagtggcagcacaactacaaccccgcctcaagagtcgacgtcacatgtacaactagcaggtcccaaagaacccagttctaccctagaaattgaacttcngtcgaccgccgcggacacgggcctatattatcgtggcgagagattcctaatcgatacagtagaggacgggggngaactggctcgacccgtggggccagggaccttcggtcaccgtctccgtcacgtccttcgaacccg

SEQ ID NO: 318083 - DNA, 528 bp, Homo sapiens
  misc_feature: GZ8MTXP01A1MG0.44.35.D02.1.454.CMB.2.raw
  modified_base (278)..(278): a, c, t, g, unknown or other
  misc_feature (278)..(278): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataattgcttcctgtatcagcagaggccaggccagcccctangctggtcatctttcaggataataagcggccctcgaggggactccctgacgcgcttcctctggctccaactctgggaacacggcccactctgacccatcagcgcgacccagcctcgtcggatgaggctgactattactgtcagacgtgggaaagtgcgtaaagttgggtgttcgggcgggagggcccaaggcttgacgttcgtcggtcacggcccacggctcgcccccgtcggcacctcgttcgttccccc

SEQ ID NO: 318084 - DNA, 618 bp, Homo sapiens
  misc_feature: GZ8MTXP01EX14X.44.35.D02.1.454.CMB.2.raw
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggactggagtggattgggcgcatctataacgngtgcagcacaactaccaacccncanaagagtcgacgtaccacatcgacaaactagaacgacgtaccaaacgacctagttaccacctagtaacttacgtacttacgtacgtacgaccgaccggacgacgaccggtacgtaatagttagttagtacgggtacgaagtacgtacttaccgtatacgtaagtacgtaggtaaggaacggggacgggggacgtaacgtcggccgtaccggacccggtacgggaccgaccgggttacccgttcggtaaccgaccgtccgtccgtacgacgtccgttccgaaccg

SEQ ID NO: 318085 - DNA, 575 bp, Homo sapiens
  misc_feature: GZ8MTXP01BG39O.44.35.D02.1.454.CMB.2.raw
  modified_base (339)..(339): a, c, t, g, unknown or other
  misc_feature (339)..(339): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattgggcgcatctataacagtggcagcaccaactacaaccccgcctcaagngtcgacgtcacatgtcaactagcaggtcccaaagaccagttcctaccctagaaattgaactttctgtcgacccgtcccggcggacacggccgttatacttagttgtggcgagagtattcctagtcgataactaggtaggacgggacggggggcgaacgtcgggctccggccccgtggggcccgacggggacccttcgggtccaccggtcctcccgtcgacgtcccttccgaacccg

SEQ ID NO: 318086 - DNA, 714 bp, Homo sapiens
  misc_feature: GZ8MTXP01DYAD0.44.35.D02.1.454.CMB.2.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatcctcactgtccgtcgtccccaggacacacagtcactattacctgctcgtagggaaaacttgagtgaataattgcttctgtatcagcagagccaggccacgccccctatcgctgtcatctttcaggataataagcggcctgaggctccgngagcgcttcnctggctccaactcgtagggaaccacgggcccaactctcgacccatccacgccgaccgacccacggtccctacgtacggtagtacggtaacgggtccttaacggtaacctttaactttaacccgttacggggtttaaccccggaaggggttaaaacccggggttacggggggtaaaaaagtttcggtaaccggtttaaaaggttttcggggggttacgggtttaccggggggaccgggttaacgggggaacccgtaaagggttccggttacgggttaacccggttcgtccggggttaccgaccggttcccgaaacgggtcccgtacccggtcccccgttacggggtcccttacccgttccggttaaccgtttcccccccg

SEQ ID NO: 318087 - DNA, 827 bp, Homo sapiens
  misc_feature: GZ8MTXP01A2EC6.44.35.D02.1.454.CMB.2.raw
  modified_base (190)..(190): a, c, t, g, unknown or other
  misc_feature (190)..(190): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatattcttagtcttaactttgtctcctggtatcaacatcatccaggtaaacgcccccaaatcatcatctatgaggacctaataagacggtccccttacgtagggggttttacctaaagttccgtcctttcccaaccttcggtacccttacccgaaacggttccccgggaccaacccgaacccgggtccccttaccccgttacggaacctaaacgtttcccgtaccgttcgggggtcccttaccccggaacggggtccgttacgggaacgggggaaaccccggtaagggggtccttaggggttaaacttttaaacgtttaacgtttagggtttacgggtcctttacgtaaacggttaagtttcgggttttaccggtccggtaccttaacgttaccgttaaccttttaaggttcggtttacccgtttaacgggggtaaacgggtttacgggggaaacccgttaaacgggttcccgtaaaccccgggtttcccggttaaaccgggttcccgaaacccggtaacccccgtaaacggggtaaccccccaaaaccccccggtacttaccgggttaaccccgttaacccgttttaacccccg

SEQ ID NO: 318088 - DNA, 561 bp, Homo sapiens
  misc_feature: GZ8MTXP01D9YQ7.44.35.D02.1.454.CMB.2.raw
  modified_base (311)..(311): a, c, t, g, unknown or other
  misc_feature (311)..(311): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattgggcgcatctataacagtncgggggacaccaactaccaaccccgcctcaagagtcacgtcacatgtcaactagaacaggtaccaaagaaccagttctccctagaaacttgacttctgtgacccgcgcggacacggacgtatattattgtggcgagtagtacttcctatcgatacgagtaggaggacggggggcgaaacgtggcgtccgacccgtggggcccacggggacccttcggtccaccgtctcctcgacgtccttccgaacccgg

SEQ ID NO: 318089 - DNA, 660 bp, Homo sapiens
  misc_feature: GZ8MTXP01ECYME.44.35.D02.1.454.CMB.2.raw
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaaacttgagtgaataaatttgcttcctggtatcagcagaggccaggccacgccccctatgctggtcatctttcaggataanaagcggccctgagggactcccgtgacgcgcttcctctggcctccaactcgtagggaacacggccactctgaccatcagcncgaccagcctcgtaggatggaggctacgacttaacttacgttggggtaccgtaggtaacggttagggggaaaacgttggtaccgtttaaagggtttgggggttcgggtttaccgggggacggggtaacgggggtaacccgaaagggtccgttagggtaaccccggttttcgtaccgggttccgttaaccgggcccccggaaagggtccccgttcccggtcccccccgttcggggtccccgttacctttcccgtttcccggtttaaccccccc

SEQ ID NO: 318090 - DNA, 684 bp, Homo sapiens
  misc_feature: GZ8MTXP01BODZJ.44.35.D02.1.454.CMB.2.raw
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgataattgcttcctggtatcagcagagccaggccagcccctatgctggtcatctttcaggataatagcgcctcgaggactcccgtgacgcgcttccnctggcctccaacgtccgtagggaaccncggcccaactccgtagacccatccagcgaccgacccaggccctgtacggtatgaacgggtctacgaaccttatttaaccgtgggtaccaagggtaccgggttaaggggaaaagttcggaacgtttaaagtttcgggggtaggttttaccgggggacggggtaacgggaacccctaaagggtcccgttacgggttaaaccccggttttcggtaccgggttaccgacccgggttacccccgaaagggggtcccctttaccccgggccccccccgtttcggggtttccccaacccgttttccccggttcccgttttcccccccccgg

SEQ ID NO: 318091 - DNA, 572 bp, Homo sapiens
  misc_feature: GZ8MTXP01AI6WT.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaaggactggagtggattgggcgcatctataacagtggcagcaccaactacaaccccgcctcaagagtcgacgtcaccatcgtcaactagaacagggtacccaaagaacccagttcctacccctagaaacttgaaccttctcgtcgacccgccgcggacacggccgtatattattgtggcgagagattcctatcgatacgagtaggagggacgggggcgaacgtgggctccggacccgtggggcccgacgggacccgttggtccaccggtctccctcgacgtcccttccgaacccgg

SEQ ID NO: 318092 - DNA, 649 bp, Homo sapiens
  misc_feature: GZ8MTXP01AMINQ.44.35.D02.1.454.CMB.2.raw
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtaggggaaaacttgagtagaataaatttgcttcgtggtatcagcagaggccaggccacgcccctatcgctggtctattctttacgaaggtaataaagtaacggccggtcccctacgaacgggtactcccgtggacgtcgtccttcctcgtcggcctaccacgtcgtacgggaaccncggccactctacgaccancacgccgccgacccgcgtcctcgtgggactggacggctacgtacttaacgtttacgtcgggtacgaaggtacggtaggggtaaagtggtacgttaaggtttcgggggtcggttccggggacgggtacgggaccgaaggtcgttccggtaccggttcgtcgggtacgttaccggccgacgggtcccgtcccggtccccgtcggtacccttaccgttccttcccgttaaccccc

SEQ ID NO: 318093 - DNA, 522 bp, Homo sapiens
  misc_feature: GZ8MTXP01C8216.44.35.D02.1.454.CMB.2.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (443)..(443): a, c, t, g, unknown or other
  misc_feature (443)..(443): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacngtcgctcaccctntcctgcactggaactaatactgatgttagaaaatataaccttgtctctggtacaagtanaccagtaacccccaatcctnttangaatcaatagcgcctggcatttcncatcgcttctcaggctccaagtctaggcaacacggccttcgttgataaatttctgtcctctgcctgacgacgaggccgacttatattgctgctcatatgcggggtctagattagtggtcttcggnggacgggccgtcgtgccgtctggtcacgtcccgaagcgtcgccccgttggcaactctcgtcccaccttctcttaataac

SEQ ID NO: 318094 - DNA, 830 bp, Homo sapiens
  misc_feature: GZ8MTXP01AIWUE.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgaggggtccggggcctcctctgacctgactcagccatcctcactcgtccgtcgtccccaggacacacagtcactattacctgctcgtaggggaaaacttggagtagaattaattgcttctgtatcagcagacggccaggcccacgccccctagtcgctggtcattctttacgaggtaataaagtaacggcccgggaccccttacggaacgggggtactcccccgttaggacgtcccggtcctttcccgtccgtcgggaccctacccgtaacgttccggttaacgggggaacccacccggggtaccctacgttccgtaccggaaccctacgtacccgacggacccgaccccggacccccgaacggtccccgtacggtacggggtacgttacgggaccgggtccttacggtaacctttaacgtttaccgtacggggttacgaaacggggtaccgggttaaaggggtaaacgttcggtaaccgtttaaagggtttcggggggttacgggtttccgggggaccgggggtaaacggggtaacccgtaaacgggtccggttcggggtaaacccggtttcccgggttaccggggttaccgaaccgggttacccccgggttaagggtccccgttccccggtccccccggttcgggtaccccgttaccgttccccgttaaccccggtttaacccccccg

SEQ ID NO: 318095 - DNA, 621 bp, Homo sapiens
  misc_feature: GZ8MTXP01DXDLH.44.35.D02.1.454.CMB.2.raw
  modified_base (294)..(294): a, c, t, g, unknown or other
  misc_feature (294)..(294): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaggctggagtggatgggcncatctataacagtggcagcaaccaactaccaaccccgcctacaagacgtcgaacgtccaacatcgtaccaaactagaacgaggtacccaaagaaccctagttcctaccctagtaaattcgtacttctagtcgacccggaccgacggacgaccggaccgtatacttattcgtaggacgaagtagtacttcctatcgatacgagtaggacgggacggggggcgaacgtcggccgtccggaccccggtcgggggacccgaacggggaccccgttcgggtaacccgtacccgtccgttcccgtaccgacggtccccgttcccgaaccccgg

SEQ ID NO: 318096 - DNA, 571 bp, Homo sapiens
  misc_feature: GZ8MTXP01EE7KB.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcttcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattggggcgcatctataacagtggcagcaccaactacaaccccgcctcaagagtcgacgtcacatgtcaactagaacaggtaccaaagaaccagttctccctagaaattgacttctgtgaccgccgcggtacacggcgtatacttattgtggcgagagtattctatcgatacgagtagaggtacgggggcgaaacgtcggcgtccggacccgtcggggaccacggggacccgttcgggtccgaccgtctcccgtcacggtcccttaacccgaaccccgg

SEQ ID NO: 318097 - DNA, 756 bp, Homo sapiens
  misc_feature: GZ8MTXP01BCV0Z.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgaggggtccggggcctcctctgacctgactcagccatcctcactgtccgtgtccccaggacacacagtcactattacctgctcgtaggggaaaacttgagtgaattaaattgcttctggtatcagcagaggccaggccacgcccctatcgcgtggtcagttctttacgaaggtataaacgtaacggccggtccctacgagggtactccccgtagacgtcgtcctttcctaccgtggcctacccgtaacgtcgtacgggaacctaccgggccctaccgtcctacggacccaatccgacgcccgaccgaaccccgcgaccccgtgtacgggtacgtcggaacgggtccttacggtaaccttaacgtttaccgtacggggttacggtaaacggggtaaccgggttaacggggtaaaaggttcggtaaccggtttaaggttcgggggttaaccgggtttcccgggggacggggaaaccggggtaccgaaacgggtcgttaccgggttacccggttggttaacccgggtccggaccggttacccggaacgggttccccgtacccggtccccccggttccgggtaccttaccccgtttcccggttcccgtttaacccccccg

SEQ ID NO: 318098 - DNA, 654 bp, Homo sapiens
  misc_feature: GZ8MTXP01B5WZK.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtaggggaaaacttgagtgaataattgcttcctggtatcagcagaggccaggcccacgccccctatcgctggtcatctttcaggataacgtaagccggccctacgagggactcccgtgacgcgtctttcctccgtggcctccaactcgtacgggaacccacgggcccacctcgtacgacccatccgacgccgaccgacccacgcccttacgtcgggactggacgggtcctaggtaacttattaacgtggggtacgaagggtaccggttaggggaaagtggtaccgttaaaggtttcggggtggtttaccggggaccggggaagggtacctaaagggccttcgggtaacccgttcgtacccgggtcgaccggcccgaacggtcccgtacccgcccccgttcgggtcccttaccgttcccgttccggtttcccccg

SEQ ID NO: 318099 - DNA, 596 bp, Homo sapiens
  misc_feature: GZ8MTXP01ASJQS.44.35.D02.1.454.CMB.2.raw
  modified_base (444)..(444): a, c, t, g, unknown or other
  misc_feature (444)..(444): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggacacacagtcactattacctgctcgtagggaaaacttgagtgaattaatttgcttctgtatcagcagaggccaggccacgcccctatcgctgtcattctttacgagataagtaacgccggtccctgacgggactcccgtgacgcgtcttcctctggcctaccaactcgtacgggaacaccggcccactctcgaccatcacgcgaccgacccagcctcgtaggactggacggctgaacttattacgnggtacgaggtacggtagggaaagtcgtagtaaggttgggtgttcgggacggacgggacgaagtccgttacggtaccgttcgtcggtcaccgttccgaacggtcctccggtccccccgtgggtcccttaccgttcccgttcccgttaaccccc

SEQ ID NO: 318100 - DNA, 639 bp, Homo sapiens
  misc_feature: GZ8MTXP01D8212.44.35.D02.1.454.CMB.2.raw
  modified_base (294)..(294): a, c, t, g, unknown or other
  misc_feature (294)..(294): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattatggagttggctgcgcagtccgcgggaaggctggagtggatgggcncatctatacagtgcagcaaccaactaccaaccccgcctacaagacgtcgaacgtccacctatcgtacaactagaacgacggtaccaaagaaccctagttacctcccttaagaaattgactttcgtcgtcgacccgaccgacggaccgacggtccgttatacttagttgtacggacgagatacgttacctagtacgatacgtagtaagggtacggggacggggggcgaaacggttcgggaccgtacccgggttacccggtacgggggtacccgaaccgggggttacccgttcgggtaacctacccgggttcctccgtccgaccgtccccgttaacccgaaccccgg
